(12) United States Patent
Damude et al.

(10) Patent No.: US 8,637,733 B2
(45) Date of Patent: Jan. 28, 2014

(54) PLANT MEMBRANE BOUND O-ACYL TRANSFERASE (MBOAT) FAMILY PROTEIN SEQUENCES AND THEIR USES FOR ALTERING FATTY ACID COMPOSITIONS

(75) Inventors: Howard Glenn Damude, Hockessin, DE (US); Knut Meyer, Wilmington, DE (US)

(73) Assignee: E.I. du Pont de Nemours and Company, Wilmington, DE (US)

( * ) Notice: Subject to any disclaimer, the term of this patent is extended or adjusted under 35 U.S.C. 154(b) by 266 days.

(21) Appl. No.: 12/969,782

(22) Filed: Dec. 16, 2010

(65) Prior Publication Data

US 2011/0162104 A1    Jun. 30, 2011

Related U.S. Application Data

(60) Provisional application No. 61/290,172, filed on Dec. 24, 2009.

(51) Int. Cl.
| | | |
|---|---|---|
| *C12N 15/87* | (2006.01) | |
| *C12N 15/82* | (2006.01) | |
| *A01H 5/00* | (2006.01) | |
| *A01H 5/10* | (2006.01) | |
| *C12N 15/31* | (2006.01) | |
| *C12N 1/19* | (2006.01) | |
| *C12N 15/54* | (2006.01) | |
| *C12P 7/64* | (2006.01) | |

(52) U.S. Cl.
USPC ........... 800/281; 800/306; 800/312; 800/314; 800/320.1; 536/23.2; 536/23.74; 435/252.3; 435/255.1; 426/531

(58) Field of Classification Search
None
See application file for complete search history.

(56) References Cited

U.S. PATENT DOCUMENTS

| | | | |
|---|---|---|---|
| 7,230,090 B2 | 6/2007 | Cahoon et al. | |
| 7,244,563 B2 | 7/2007 | Cahoon et al. | |
| 7,256,033 B2 | 8/2007 | Damude et al. | |
| 2004/0031072 A1* | 2/2004 | La Rosa et al. | 800/278 |
| 2007/0118929 A1 | 5/2007 | Damude et al. | |
| 2008/0254191 A1 | 10/2008 | Damude et al. | |

FOREIGN PATENT DOCUMENTS

| | | | |
|---|---|---|---|
| AU | WO2009129582 | * 10/2009 | A01H 5/00 |
| WO | WO2004011671 A2 | 2/2004 | |
| WO | WO 2004/071467 | 8/2004 | |
| WO | WO 2008/063340 | 5/2008 | |
| WO | WO2008104559 A1 | 9/2008 | |
| WO | WO 2008/124048 | 10/2008 | |
| WO | WO2008130248 A1 | 10/2008 | |
| WO | WO 2008/137516 | 11/2008 | |
| WO | WO2009129582 A1 | 10/2009 | |

OTHER PUBLICATIONS

Hishikawa et al 2008 PNAS 105:8 p. 2830-2835.*
Benghezal, et al., "SLC1 and SLC4 Encode Partially Redundant Acyl-Coenzyme A 1-Acylglycerol-3-phosphate O-Acyltransferases . . . ", J. Biol.Chem., vol. 282, pp. 30845-30855 (2007).
Chen, et al., "The yeast acylglyceroi acyltransferase LCA1 is a key component of Lands cycle for phosphatidylcholine turnover", FEBS Letters, vol. 581, pp. 5511-5516 (2007).
Gijon et al, "Lysophospholipid Acyltransferases and Arachidonate Recycling in Human Neutrophils", J. Biol. Chem., vol. 283, pp. 30235-30245 (2008).
Jain, et al., "Identification of a Novel Lysophospholipid Acyltransferase in *Saccharomyces cerevisiae*", J. Biol. Chem., vol. 282, pp. 30562-30569 (2007).
Kazachkov, et al., "Substrate preferences of a lysophosphatidylcholine acyltransferase highlight its role in phospholipid remodeling", Lipids, vol. 43, pp. 895-902 (2008).
Lardizabal, et al., "DGAT2 is a New Diacylglycerol Acyltransferase Gene Family", J. Biol. Chem., vol. 276, pp. 38862-38869 (2001).
Riekhof, et al., "Identification and Characterization of the Major Lysophosphatidylethanolamine Acyltransferase in . . . ", J. Biol. Chem., vol. 282, pp. 28344-28352 (2007).
NCBI Accession No. ABI83668 (GI:114848908).
NCBI Accession No. ACO35365 (GI:225904451).
NCBI Accession No. ACO90188 (GI:226897458).
NCBI Accession No. EEF51096 (GI:223549608).
NCBI Accession No. NP_172724 (GI:P2239514).
NCBI Accession No. NP_566952 (GI:18409359).
NCBI Accession No. XP_002509709 (GI:255537285).
NCBI Accession No. XP_002282807 (GI:225426775).
NCBI Accession No. XP_002263626 (GI:225431649).
Corresponding international Search Report and Written Opinion (PCT/US2010/060654) dated May 25, 2011.
Cahoon E B et al., Conjugated fatty acids accumulate to high levels in phospholipids . . . , Phytochemistry, Pergamon Press, GB, vol. 67, No. 12, Jun. 1, 2006.
Cahoon, et al., Engineering oilseeds for sustainable production of . . . , Current Opinion in Plant Biology, Quadrant Subscription Services, GB, vol. 10, No. 3, Jun. 1, 2007.
Dyer, J M et al., Engineering plant oils as high-value industrial feedstocks . . . , Physiologia Plantarum, Munksgaard International Publishers, vol. 132, No. 1, Jan. 1, 2008.
Lardizabal K., et al., Expression of Umbelopsis ramanniana DGAT2A in seed . . . , Plant Physiology, Am Society of Plant Physiologists, vol. 148, No. 1, Sep. 1, 2008.

* cited by examiner

*Primary Examiner* — David T Fox
*Assistant Examiner* — Matthew Keogh

(57) ABSTRACT

This invention is in the field of biotechnology, in particular, this pertains to polynucleotide sequences encoding membrane bound O-acyltransferase genes and the use of these acyltransferases for altering fatty acid profiles in oilseed plants. Methods for increasing elongation and desaturation conversion efficiencies are also disclosed.

16 Claims, 1 Drawing Sheet

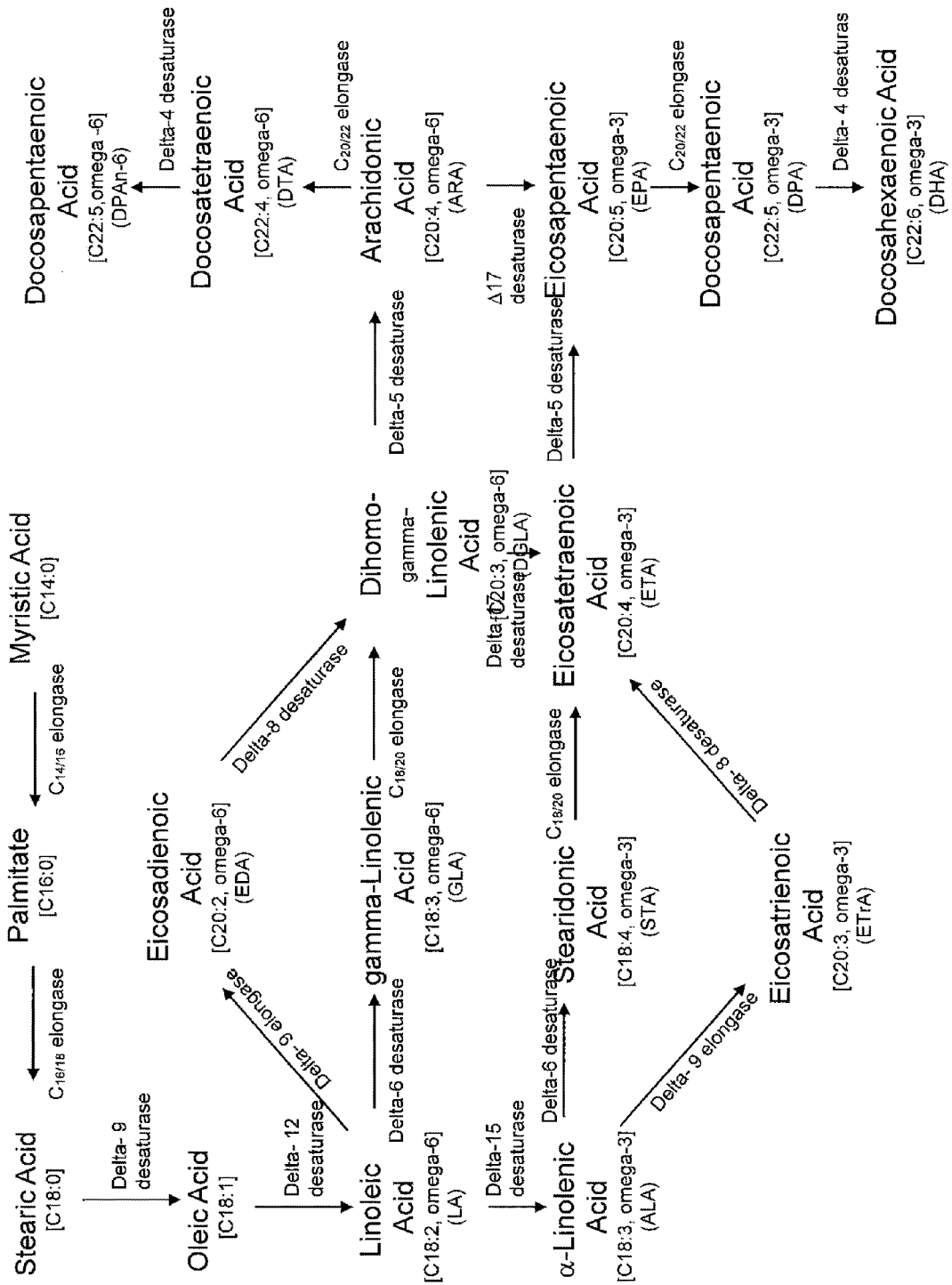

PLANT MEMBRANE BOUND O-ACYL TRANSFERASE (MBOAT) FAMILY PROTEIN SEQUENCES AND THEIR USES FOR ALTERING FATTY ACID COMPOSITIONS

CROSS-REFERENCE TO RELATED APPLICATIONS

This application claims the benefit of U.S. Provisional Application No. 61/290,172, filed Dec. 24, 2009, which is incorporated herein by reference in its entirety.

FIELD OF THE INVENTION

This invention is in the field of biotechnology, in particular, this pertains to polynucleotide sequences encoding membrane bound O-acyltransferase genes and the use of these acyltransferases for altering fatty acid profiles in oilseed plants.

BACKGROUND OF THE INVENTION

Plant lipids have a variety of industrial and nutritional uses and are central to plant membrane function and climatic adaptation. These lipids represent a vast array of chemical structures, and these structures determine the physiological and industrial properties of the lipid. Many of these structures result either directly or indirectly from metabolic processes that alter the degree of unsaturation of the lipid. Different metabolic regimes in different plants produce these altered lipids, and either domestication of exotic plant species or modification of agronomically adapted species is usually required to produce economically large amounts of the desired lipid.

There are serious limitations to using mutagenesis to alter fatty acid composition and content. Screens will rarely uncover mutations that a) result in a dominant ("gain-of-function") phenotype, b) are in genes that are essential for plant growth, and c) are in an enzyme that is not rate-limiting and that is encoded by more than one gene. In cases where desired phenotypes are available in mutant crop lines, their introgression into elite lines by traditional breeding techniques is slow and expensive, since the desired oil compositions are likely the result of several recessive genes.

Recent molecular and cellular biology techniques offer the potential for overcoming some of the limitations of the mutagenesis approach, including the need for extensive breeding. Some of the particularly useful technologies are seed-specific expression of foreign genes in transgenic plants [see Goldberg et al. (1989) *Cell* 56:149-160], and the use of antisense RNA to inhibit plant target genes in a dominant and tissue-specific manner [see van der Krol et al. (1988) *Gene* 72:45-50]. Other advances include the transfer of foreign genes into elite commercial varieties of commercial oilcrops, such as soybean [Chee et al (1989) *Plant Physiol.* 91:1212-1218; Christou et al. (1989) *Proc. Natl. Acad. Sci. U.S.A.* 86:7500-7504; Hinchee et al. (1988) *Bio/Technology* 6:915-922; EPO publication 0 301 749 A2], rapeseed [De Block et al. (1989) *Plant Physiol.* 91:694-701], and sunflower [Everett et al. (1987) *Bio/Technology* 5:1201-1204], and the use of genes as restriction fragment length polymorphism (RFLP) markers in a breeding program, which makes introgression of recessive traits into elite lines rapid and less expensive [Tanksley et al. (1989) *Bio/Technology* 7:257-264]. However, application of each of these technologies requires identification and isolation of commercially-important genes.

Glycerophospholipids in biological membranes are metabolically active and participate in a series of deacylation-reacylation reactions, which may lead to accumulation of polyunsaturated fatty acids (PUFAs) at the sn-2 position of the glycerol backbone. The reacylation reaction is believed to be catalyzed by Acyl-CoA:lysophosphatidylcholine acyltransferase (LPCAT)), which catalyzes the acyl-CoA-dependent acylation of lysophosphatidylcholine (LPC) to produce Phosphatidylcholine (PC) and CoA. LPCAT activity may affect the incorporation of fatty acyl moieties at the sn-2 position of PC where PUFA are formed and may indirectly influence seed triacylglycerol (TAG) composition. LPCAT activity is associated with two structurally distinct protein families, wherein one belongs to the Lysophosphatidic acid acyltransferase (LPAAT) family of proteins and the other belongs to the membrane bound O-acyltransferase ["MBOAT"] family of proteins. In yeast, YOR175c, an acyltransferase belonging to the MBOAT family of proteins, has recently been shown to represent a major acyl-CoA dependent lysophospholipid acyltransferase (Wayne et al.; JBC, 2007, 282:28344-28352). It further was shown by Sandro Sonnino (FEBS Letters, 2007, 581:5511-5516) that the yeast acylglycerol acyltransferase LCA1 (YOR175c) is a key component of the Lands cycle for phosphatidylcholine turnover.

Stanford et al. (JBC, 2007, 282:30562-30569) found that in yeast the LTP1 gene encodes for an acyltransferase that uses a variety of lysophospholipid species. Together with Slc1, Lpt1p seems to mediate the incorporation of unsaturated acyl chains into the sn-2 position of phospholipids.

Benghezal et al. (JBC, 2007, 282:30845-30855) show that Slc1p and Slc4p appear to be active not only as 1-acylglycerol-3-phosphate O-acyltransferases but also appear to be involved in fatty acid exchange at the sn-2-position of mature glycerophospholipids.

A newly discovered human LPCAT (LPCAT3), which has distinct substrate preferences, has been identified (Kazachkov et al., Lipids, 2008, 43:895-902). Kazachkov et al. suggest that LPCAT3 is involved in phospholipids remodeling to achieve appropriate membrane lipid fatty acid composition.

Four human MBOATs have been expressed in yeast and two of them, MBOAT5 and MBOAT7 have been implicated in arachidonate recycling, thus regulating free arachidonic acid levels and leukotriene synthesis in neutrophils (Gijon et al., JBC, 2008, 283:30235-30245).

Altogether more than 300 different fatty acids are known to occur in seed TG. Chain length may range from less than 8 to over 22 carbons. The position and number of double bonds may also be unusual, and hydroxyl, epoxy, or other functional groups can modify the acyl chain. The special physical and chemical properties of the unusual plant fatty acids have been exploited for centuries. Approximately one-third of all vegetable oil is used for non-food purposes. The ability to transfer genes for unusual fatty acid production from exotic wild species to high yielding oilcrops is now providing, for example, the ability to produce new renewable agricultural products (Biochemistry of lipids, lipoproteins and membranes, ed. D. E. Vance and J. Vance, 1996 Elsevier Science).

Given the acyl-editing activity of the MBOAT protein family of genes, it is of interest to find other plant homologs with similar activities and characterize the effect of their expression on seed oil composition.

BRIEF DESCRIPTION OF THE DRAWINGS AND SEQUENCE DESCRIPTIONS

FIG. 1 illustrates the ω-3/ω-6 fatty acid biosynthetic pathway.

The invention can be more fully understood from the following detailed description and the accompanying sequence descriptions, which form a part of this application.

The following sequences comply with 37 C.F.R. §§1.821-1.825 ("Requirements for patent applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

SEQ ID NO:1 corresponds to the cDNA insert sequence from esc1c.pk007.c17 (CoMBOAT).

SEQ ID NO:2 corresponds to the ORF encoded by SEQ ID NO:1.

SEQ ID NO:3 corresponds to the amino acid sequence encode by SEQ ID NO:2.

SEQ ID NO:4 corresponds to the amino acid sequence of the MBOAT family protein from *Vitis vinifera* (GI: 225426775).

SEQ ID NO:5 corresponds to the amino acid sequence of the MBOAT family protein from *Arebidopsis thaliana* (GI: 22329514).

SEQ ID NO:6 corresponds to cDNA insert sequence from fds1n.pk001.k4 (McMBOAT).

SEQ ID NO:7 corresponds to the McLPCAT 5Race primer.

SEQ ID NO:8 corresponds to the McLPCATnew1 primer.

SEQ ID NO:9 corresponds to the McMBOAT 5'RACE sequence.

SEQ ID NO:10 corresponds to the McMBOAT full cDNA sequence.

SEQ ID NO:11 corresponds to the ORF encoded by SEQ ID NO:10.

SEQ ID NO:12 corresponds to the amino acid sequence encoded by SEQ ID NO:11.

SEQ ID NO:13 corresponds to the cDNA insert sequence from esc1c.pk002. d16 (CoDGAT2).

SEQ ID NO:14 corresponds to the ORF encoded by SEQ ID NO:13.

SEQ ID NO:15 corresponds to the amino acid sequence encoded by SEQ ID NO:14.

SEQ ID NO:16 corresponds to the hypothetical protein from *Vitis vinifera* (GI:225431649).

SEQ ID NO:17 corresponds to the amino acid sequence of diacylglycerol acyltransferase from *Elaeis oleifera*.

SEQ ID NO:18 corresponds to the DNA insert sequence from fds.pk0003.97 (McDGAT2).

SEQ ID NO:19 corresponds to the McDGAT2 Race1 primer.

SEQ ID NO:20 corresponds to the McDGAT2 5'Race sequence.

SEQ ID NO:21 corresponds to the McDGAT2 Not5 primer.

SEQ ID NO:22 corresponds to the McDGAT2 Not3 primer.

SEQ ID NO:23 corresponds to the McDGAT2 sequence flanked by NotI sites.

SEQ ID NO:24 corresponds to the full McDGAT2 cDNA sequence.

SEQ ID NO:25 corresponds to the ORF encoded by SEQ ID NO:24.

SEQ ID NO:26 corresponds to the amino acid sequence encoded by SEQ ID NO:25.

SEQ ID NO:27 corresponds to diacylglycerol acyltransferase from *Arabidopsis thaliana*.

SEQ ID NO:28 corresponds to the nucleotide sequence of vector pHD40.

SEQ ID NO:29 corresponds to the nucleotide sequence of vector pKR1543.

SEQ ID NO:30 corresponds to the gene coding sequence of the *Momordica charantia* conjugase (McConj).

SEQ ID NO:31 corresponds to the nucleotide sequence of vector pKR458.

SEQ ID NO:32 corresponds to the McLPCATNOt5 primer.

SEQ ID NO:33 corresponds to the McLPCATNot3 primer.

SEQ ID NO:34 corresponds to the nucleotide sequence of vector pHD41.

SEQ ID NO:35 corresponds to the nucleotide sequence of vector pKR1548.

SEQ ID NO:36 corresponds to the nucleotide sequence of vector pKR1556.

SEQ ID NO:37 corresponds to the nucleotide sequence of vector pKR1562.

SEQ ID NO:38 corresponds to the CoDGAT-5Not primer.

SEQ ID NO:39 corresponds to the CoDGAT-3Not primer.

SEQ ID NO:40 corresponds to the nucleotide sequence of vector pKR1493.

SEQ ID NO:41 corresponds to the nucleotide sequence of the ORF of *Calendula officinalis* fatty acid conjugase (Co-Conj).

SEQ ID NO:42 corresponds to the nucleotide sequence of vector pKR1487.

SEQ ID NO:43 corresponds to the CoLPCAT-5Not primer.

SEQ ID NO:44 corresponds to the CoLPCATNco-3 primer.

SEQ ID NO:45 corresponds to the CoLPCATNco-5 primer.

SEQ ID NO:46 corresponds to the CoLPCAT-3Not primer.

SEQ ID NO:47 corresponds to the nucleotide sequence of CoMBOAT with the NcoI site removed.

SEQ ID NO:48 corresponds to the nucleotide sequence of vector pLF166.

SEQ ID NO:49 corresponds to the nucleotide sequence of vector pKR1492.

SEQ ID NO:50 corresponds to the nucleotide sequence of vector pKR1498.

SEQ ID NO:51 corresponds to the nucleotide sequence of vector pKR1504.

SEQ ID NO:52 corresponds to the nucleotide sequence of vector pKR539.

SEQ ID NO:53 corresponds to the nucleotide sequence of vector pKR1563.

SEQ ID NO:54 corresponds to the nucleotide sequence of vector pKR1564.

SEQ ID NO:55 corresponds to the nucleotide sequence of vector pKR1565.

SEQ ID NO:56 corresponds to the nucleotide sequence of vector pKR1507.

SEQ ID NO:57 corresponds to the nucleotide sequence of vector pKR1508.

SEQ ID NO:58 corresponds to the nucleotide sequence of vector pKR1509.

SEQ ID NO:59 corresponds to the nucleotide sequence of vector pKR1510.

SEQ ID NO:60 corresponds to the nucleotide sequence of vector pKR1561.

SEQ ID NO:61 corresponds to the nucleotide sequence of vector pKR1544.

SEQ ID NO:62 corresponds to the nucleotide sequence of vector pKR1549.

SEQ ID NO:63 corresponds to the nucleotide sequence of vector pKR1546.

SEQ ID NO:64 corresponds to the nucleotide sequence of vector pKR1557.

SEQ ID NO:65 corresponds to the nucleotide sequence of vector pKR1560.

SEQ ID NO:66 corresponds to the nucleotide sequence of vector pKR1545.

SEQ ID NO:67 corresponds to the nucleotide sequence of vector pKR1550.

SEQ ID NO:68 corresponds to the nucleotide sequence of vector pKR1547.

SEQ ID NO:69 corresponds to the nucleotide sequence of vector pKR1558.

SEQ ID NO:70 corresponds to the nucleotide sequence of vector pKR1559.

SEQ ID NO:71 corresponds to the nucleotide sequence of vector pKR1552.

SEQ ID NO:72 corresponds to the nucleotide sequence of vector pKR1554.

SEQ ID NO:73 corresponds to the nucleotide sequence of vector pKR1022.

SEQ ID NO:74 corresponds to the nucleotide sequence of vector pKR1553.

SEQ ID NO:75 corresponds to the nucleotide sequence of vector pKR1555.

SEQ ID NO:76 corresponds to the nucleotide sequence of vector pLF167.

SEQ ID NO:77 corresponds to the nucleotide sequence encoding the fatty acid desaturase (nt1-nt 1149 (STOP)) from *Vernonia galamensis*.

SEQ ID NO:78 corresponds to the amino acid sequence encoded by SEQ ID NO:77.

SEQ ID NO:79 corresponds to the nucleotide sequence encoding an epoxidase from *Vernonia galamensis*.

SEQ ID NO:80 corresponds to the amino acid sequence encoded by SEQ ID NO:79.

SEQ ID NO:81 corresponds to the nucleotide sequence encoding the delta-5 acyl-CoA desaturase from *Limnanthes alba*.

SEQ ID NO:82 corresponds to the amino acid sequence encoded by SEQ ID NO:81.

SEQ ID NO:83 corresponds to the nucleotide sequence encoding the fatty acyl-CoA elongase from *Limnanthes alba*.

SEQ ID NO:84 corresponds to the amino acid sequence encoded by SEQ ID NO:83.

SEQ ID NO:85 corresponds to the nucleotide sequence encoding the a conjugase from *Impatiens balsamina*.

SEQ ID NO:86 corresponds to the amino acid sequence encoded by SEQ ID NO:85.

SEQ ID NO:87 corresponds to the nucleotide sequence encoding a conjugase from *Momordica charantia*.

SEQ ID NO:88 corresponds to the amino acid sequence encoded by SEQ ID NO:87.

SEQ ID NO:89 corresponds to the nucleotide sequence encoding a conjugase from *Chrysobalanus icaco*.

SEQ ID NO:90 corresponds to the amino acid sequence encoded by SEQ ID NO:89.

SEQ ID NO:91 corresponds to the nucleotide sequence encoding a conjugase from *Licania michauxii*.

SEQ ID NO:92 corresponds to the amino acid sequence encoded by SEQ ID NO:91.

SEQ ID NO:93 corresponds to the nucleotide sequence encoding a conjugase from *Aleurites fordii*.

SEQ ID NO:94 corresponds to the amino acid sequence encoded by SEQ ID NO:93.

SEQ ID NO:95 corresponds to the nucleotide sequence encoding a Class II conjugase from *Aleurites fordii*.

SEQ ID NO:96 corresponds to the amino acid sequence encoded by SEQ ID NO:95.

SEQ ID NO:97 corresponds to the amino acid sequence from the hydroxylase from *Ricinus communis*.

SEQ ID NO:98 corresponds to the nucleotide sequence of a conjugase from *Calendula officialis*.

SEQ ID NO:99 corresponds to the amino acid sequence encoded by SEQ ID NO:98.

SEQ ID NO:100 corresponds to the nucleotide sequence of a conjugase from *Calendula officialis*.

SEQ ID NO:101 corresponds to the amino acid sequence encoded by SEQ ID NO:100.

SEQ ID NO:102 corresponds to the nucleotide sequence of a conjugase from *Dimorphotheca sinuata*.

SEQ ID NO:103 corresponds to the amino acid sequence encoded by SEQ ID NO:102.

SEQ ID NO:104 corresponds to the nucleotide sequence of a conjugase from *Dimorphotheca sinuata*.

SEQ ID NO:105 corresponds to the amino acid sequence encoded by SEQ ID NO:104.

SEQ ID NO:106 corresponds to the nucleotide sequence of vector pKR272.

SEQ ID NO:107 corresponds to the nucleotide sequence of vector pKR278.

SEQ ID NO:108 corresponds to the forward primer RcHydroxy-5.

SEQ ID NO:109 corresponds to the reverse primer RcHydroxy-3.

SEQ ID NO:110 corresponds to the nucleotide sequence of vector pLF241.

SEQ ID NO:111 corresponds to the nucleotide sequence of vector pKR1687.

SEQ ID NO:112 corresponds to the nucleotide sequence of vector pKR1742.

SEQ ID NO:113 corresponds to the nucleotide sequence of vector pKR1733.

SEQ ID NO:114 corresponds to the nucleotide sequence of vector pKR1745.

SEQ ID NO:115 corresponds to the nucleotide sequence of vector pKR966.

SEQ ID NO:116 corresponds to the nucleotide sequence of vector pKR1542.

SEQ ID NO:117 corresponds to the nucleotide sequence of vector pKR1743.

SEQ ID NO:118 corresponds to the nucleotide sequence of vector pKR1734.

SEQ ID NO:119 corresponds to the nucleotide sequence of vector pKR1746.

SEQ ID NO:120 corresponds to the GmMBOAT1 genomic sequence.

SEQ ID NO:121 corresponds to the GmMBOAT1 coding sequence.

SEQ ID NO:122 corresponds to the GmMBOAT1 amino acid sequence.

SEQ ID NO:123 corresponds to the GmMBOAT2 genomic sequence.

SEQ ID NO:124 corresponds to the GmMBOAT2 coding sequence.

SEQ ID NO:125 corresponds to the GmMBOAT2 amino acid sequence.

SEQ ID NO:126 corresponds to the GmLPCAT1-5 primer.

SEQ ID NO:127 corresponds to the GmLPCAT1-3 primer.

SEQ ID NO:128 corresponds to the nucleotide sequence of vector pLF164.

SEQ ID NO:129 corresponds to the GmLPCAT2-5 primer.

SEQ ID NO:130 corresponds to the nucleotide sequence of vector pLF165.

SEQ ID NO:131 corresponds to the nucleotide sequence of vector pKR1813.

SEQ ID NO:132 corresponds to the nucleotide sequence of vector pKR1814.

SEQ ID NO:133 corresponds to the nucleotide sequence of vector pKR1821.

SEQ ID NO:134 corresponds to the nucleotide sequence of vector pKR1822.

SEQ ID NO:135 corresponds to the cDNA insert sequence from eel1c.pk002.h9 (EuphMBOAT).

SEQ ID NO:136 corresponds to the ORF encoded by SEQ ID NO:135.

SEQ ID NO:137 corresponds to the amino acid sequence encoded by SEQ ID NO:136.

SEQ ID NO:138 corresponds to the EIMBOAT-5Not primer.

SEQ ID NO:139 corresponds to the oEU mb-2 primer.

SEQ ID NO:140 corresponds to the nucleotide sequence of vector pKR1823.

SEQ ID NO:141 corresponds to the nucleotide sequence of vector pKR1827.

SEQ ID NO:142 corresponds to the nucleotide sequence of vector pKR1836.

SEQ ID NO:143 corresponds to the nucleotide sequence of vector pKR1815.

SEQ ID NO:144 corresponds to the nucleotide sequence of vector pKR1835.

SEQ ID NO:145 corresponds to the nucleotide sequence of vector pKR1203.

SEQ ID NO:146 corresponds to the nucleotide sequence of vector pHD1.

SEQ ID NO:147 corresponds to the nucleotide sequence of vector pKR1645.

SEQ ID NO:148 corresponds to the nucleotide sequence of vector pKR1646.

SEQ ID NO:149 corresponds to the nucleotide sequence of vector pKR1649.

SEQ ID NO:150 corresponds to the nucleotide sequence of vector pKR1650.

SEQ ID NO:151 corresponds to the nucleotide sequence of vector pKR1818.

SEQ ID NO:152 corresponds to the nucleotide sequence of vector pKR1826.

SEQ ID NO:153 corresponds to the nucleotide sequence of vector pKR1844.

SEQ ID NO:154 corresponds to the nucleotide sequence of vector pKR1671.

SEQ ID NO:155 corresponds to the nucleotide sequence of vector pKR1672.

SEQ ID NO:156 corresponds to the nucleotide sequence of vector pKR1673.

SEQ ID NO:157 corresponds to the nucleotide sequence of vector pKR1674.

SEQ ID NO:158 corresponds to the nucleotide sequence of vector pKR1845.

SUMMARY OF THE INVENTION

The present invention concerns an isolated polynucleotide comprising:
(a) a nucleotide sequence encoding a polypeptide with MBOAT activity, wherein, based on the Clustal V method of alignment with pairwise alignment default parameters of KTUPLE=1, GAP PENALTY=3, WINDOW=5 and DIAGONALS SAVED=5, the polypeptide has an amino acid sequence of at least 80% sequence identity when compared to SEQ ID NO:3, 12, 123, 126, or 137; or
(b) the full complement of the nucleotide sequence of (a).

In a second embodiment the present invention concerns an isolated polynucleotide comprising:
(a) a nucleotide sequence encoding a polypeptide with DGAT activity, wherein, based on the Clustal V method of alignment with pairwise alignment default parameters of KTUPLE=1, GAP PENALTY=3, WINDOW=5 and DIAGONALS SAVED=5, the polypeptide has an amino acid sequence of at least 80% sequence identity when compared to SEQ ID NO:15 or 26; or
(b) the full complement of the nucleotide sequence of (a).

In a third embodiment, the invention concerns a recombinant DNA construct comprising any of the isolated polynucleotides of the invention operably linked to at least one regulatory sequence.

In a fourth embodiment, the present invention concerns a cell comprising in its genome the recombinant DNA construct of the invention. Such cells can be plant cells, microbial cells or yeast cells.

In a fifth embodiment, the invention concerns a method for transforming a cell, comprising transforming a cell with a recombinant construct of the invention or an isolated polynucleotide of the invention and selecting those cells transformed with the recombinant construct or the isolated polynucleotide.

In a sixth embodiment, the invention concerns transgenic seed comprising in its genome the recombinant construct of the invention or a transgenic seed obtained from a plant made by a method of the invention. Also of interest is oil or by-products obtained from such transgenic seeds.

In a seventh embodiment, the invention concerns a method for increasing the content of at least one unusual fatty acid in an oilseed plant cell comprising:
(a) transforming the oilseed plant cell with:
  (i) any of the recombinant constructs of the invention; and
  (ii) at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18/20 elongase, a C20/22 elongase, a DGAT, an MBOAT, a fatty acid conjugase, a hydroxylase, an acetylenase, an epoxidase and a multizyme;
(b) regeneating an oilseed plant from the transformed cell of step (a); and
(c) selecting those seeds obtained from the plants of step (b) having an increased level of at least one unusual fatty acid when compared to the level in seeds obtained from a transgenic plant comprising at least one recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16118 elongase, a C18/20 elongase, a C20/22 elongase, a DGAT, an MBOAT, a fatty acid conjugase, a hydroxylase, an acetylenase, an epoxidase and a multizyme.

In an eighth embodiment the invention concerns a method for increasing at least one conversion efficiency, wherein said conversion efficiency is at least one selected from the group consisting of: $C_{18}$ to $C_{20}$ elongation, delta-6 desaturation, the delta-9 elongation, delta-8 desaturation, conjugation to Eleostearic acid and conjugation to Calendic acid, in an oilseed plant cell comprising:
(a) transforming the oilseed plant cell with:
  (i) any of the recombinant constructs of the invention; and
  (ii) at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18/20 elongase, a C20/22 elongase, a DGAT, an MBOAT, a fatty acid conjugase, a hydroxylase, an acetylenase, an epoxidase and a multizyme;
(b) regeneating an oilseed plant from the transformed cell of step (a); and
(c) selecting those seeds obtained from the plants of step (b) having an increased $C_{18}$ to $C_{20}$ elongation conversion efficiency and an increased delta-6 desaturation conversion efficiency when compared to the level in seeds obtained from a transgenic plant comprising at least one recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18120 elongase and a C20/22 elongase, a DGAT, an MBOAT, a fatty acid conjugase, a hydroxylase, an acetylenase, an epoxidase and a multizyme.

In a ninth embodiment the invention concerns a method wherein the $C_1$ to $C_{20}$ elongation conversion efficiency is increased at least 1.1-fold and the delta-6 desaturation conversion efficiency is increased at least 2-fold; or the delta-9 elongation conversion efficiency is increased by at least 1.1-fold and the delta-8 desaturation conversion efficiency is increased by at least 1.2-fold; or the conjugation conversion efficiency to Eleosteraic acid is at least 1.2-fold; or the conjugation conversion efficiency to Calendic acid is at least 2.5-fold.

The invention further concerns methods for the production of increased levels of unusual fatty acids, wherein the unusual fatty acid include, but are not limited to, GLA, STA, EDA, ERA, DGLA, ETA, ELEO and CAL.

In another embodiment, the invention concerns an oilseed plant comprising in its genome the recombinant construct(s) of the invention. Suitable oilseed plants include, but are not limited to, soybean, Brassica species, sunflower, maize, cotton, flax, and safflower.

Also of interest are transgenic seeds and progeny plants obtained from such oilseed plants as well as oil or by-products obtained from these transgenic seeds.

In yet another embodiment, the invention concerns food or feed incorporating an oil or seed of the invention or food or feed comprising an ingredient derived from the processing of the seeds.

DETAILED DESCRIPTION OF THE INVENTION

The disclosure of each reference set forth herein is hereby incorporated by reference in its entirety.

As used herein and in the appended claims, the singular forms "a", "an", and "the" include plural reference unless the context clearly dictates otherwise. Thus, for example, reference to "a plant" includes a plurality of such plants, reference to "a cell" includes one or more cells and equivalents thereof known to those skilled in the art, and so forth.

In the context of this disclosure, a number of terms and abbreviations are used. The following definitions are provided.

"Open reading frame" is abbreviated ORF.
"Polymerase chain reaction" is abbreviated PCR.
"American Type Culture Collection" is abbreviated ATCC.
Acyl-CoA:sterol-acyltransferase" is abbreviated ARE2.
"Phospholipid:diacylglycerol acyltransferase" is abbreviated PDAT.
"Diacylglycerol acyltransferase" is abbreviated DAG AT or DGAT.
"Diacylglycerol" is abbreviated DAG.
"Triacylglycerol(s)" are abbreviated TAG(s) or TG(s).
"Co-enzyme A" is abbreviated CoA.
"Membrane membrane bound O-acyl transferase" is abbreviated MBOAT.
"Polyunsaturated fatty acid(s)" is abbreviated PUFA(s).

The term "fatty acids" refers to long chain aliphatic acids (alkanoic acids) of varying chain length, from about $C_{12}$ to $C_{22}$ (although both longer and shorter chain-length acids are known). The predominant chain lengths are between $C_{16}$ and $C_{22}$. The structure of a fatty acid is represented by a simple notation system of "X:Y", where X is the total number of carbon (C) atoms in the particular fatty acid and Y is the number of double bonds.

Generally, fatty acids are classified as saturated or unsaturated. The term "saturated fatty acids" refers to those fatty acids that have no "double bonds" between their carbon backbone. In contrast, "unsaturated fatty acids" have "double bonds" along their carbon backbones (which are most commonly in the cis-configuration). "Monounsaturated fatty acids" have only one "double bond" along the carbon backbone (e.g., usually between the $9^{th}$ and $10^{th}$ carbon atom as for palmitoleic acid (16:1) and oleic acid (18:1)), while "polyunsaturated fatty acids" (or "PUFAs") have at least two double bonds along the carbon backbone (e.g., between the $9^{th}$ and $10^{th}$, and $12^{th}$ and $13^{th}$ carbon atoms for linoleic acid (18:2); and between the $9^{th}$ and $10^{th}$, $12^{th}$ and $13^{th}$ and $15^{th}$ and $16^{th}$ for α-linolenic acid (18:3)).

The term "unusual fatty acid(s)" refers to fatty acids that deviate from the norm due to differences in chain length (i.e. greater than 18 carbons, shorter than 14 carbons), position, or number of double bonds (i.e., polyunsaturated), or due to the presence of modifications other than simple double bonds (i.e. hydroxylation, acetylation, epoxy groups etc.) and includes, but is not limited to, the fatty acids listed in Table 1.

TABLE 1

| | | | |
|---|---|---|---|
| Crepenynic | N/A* | cis-9-octadecen-12-ynoic | 18:2 |
| Dehydroerepenynic | N/A* | cis-9,14-octadecadien-12-ynoic | 18:3 |
| Linoleic | LA | cis-9,12-octadecadienoic | 18:2 |
| Eicosadienoic | EDA | cis-11,14-eicosadienoic | 20:2 |
| Gamma-linolenic | GLA | cis-6,9,12-octadecatrienoic | 18:3 |
| Dihomo-γ-Linolenic | DGLA | cis-8,11,14-eicosatrienoic | 20:3 |
| Sciadonic | SCI | cis-5,11,14-eicosatrienoic | 20:3b |
| Arachidonic | ARA | cis-5,8,11,14-eicosatetraenoic | 20:4 |
| Alpha-linolenic | ALA | cis-9,12,15-octadectrienoic | 18:3 |
| Stearidonic | STA | cis-6,9,12,15-octadecatetraenoic | 18:4 |
| Eicosenoic | N/A* | cis-5 eicosenoic | 20:1 |

TABLE 1-continued

| | | | |
|---|---|---|---|
| Eicosatrienoic | ETrA or ERA | cis-11,14,17-eicosatrienoic | 20:3 |
| Eicosa-tetraenoic | ETA | cis-8,11,14,17-eicosatetraenoic | 20:4 |
| Juniperonic | JUP | cis-5,11,14,17-eicosatrienoic | 20:4b |
| Eicosa-pentaenoic | EPA | cis-5,8,11,14,17-eicosapentaenoic | 20:5 |
| Docosatrienoic | DRA | cis-10,13,16-docosatrienoic | 22:3 |
| Docosa-tetraenoic | DTA | cis-7,10,13,16-docosatetraenoic | 22:4 |
| Docosa-pentaenoic | DPAn-6 | cis-4,7,10,13,16-docosapentaenoic | 22:5 |
| Docosa-pentaenoic | DPA | cis-7,10,13,16,19-docosapentaenoic | 22:5 |
| Docosa-hexaenoic | DMA | cis-4,7,10,13,16,19-docosahexaenoic | 22:6 |
| Alpha-eleostearic | ELEO | cis-9, trans-11, trans-13 octadecatrienoic | 18:3 |
| Dimorphecolic | DM | hydroxy-9, trans-10, trans-12 octadecadienoic | 18:2 |
| Calendic | CAL | trans-8, trans-10, cis-12 octadecatrienoic | 18:3 |
| Alpha-parinaric | PAR | cis-9, trans-11, trans-13, cis-15 octadecatetraenoic | 18:4 |
| Ricinoleic | N/A* | Hydroxy-12, cis-9 octadecenoic | 18:1 |
| Petroselinic | N/A* | cis-6 octadecenoic | 18:1 |
| Vernolic | N/A* | Epoxy-9, trans-12 octadecenoic | 18:1 |

*not available

"Desaturase" is a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. For example delta-8 desaturases will desaturate a fatty acid between the eighth and ninth carbon atom numbered from the carboxyl-terminal end of the molecule and can, for example, catalyze the conversion of EDA to DGLA and/or ETrA to ETA. Other useful fatty acid desaturases include, for example: (1) delta-5 desaturases that catalyze the conversion of DGLA to ARA and/or ETA to EPA; (2) delta-6 desaturases that catalyze the conversion of LA to GLA and/or ALA to STA; (3) delta-4 desaturases that catalyze the conversion of DPA to DHA; (4) delta-12 desaturases that catalyze the conversion of oleic acid to LA; (5) delta-15 desaturases that catalyze the conversion of LA to ALA and/or GLA to STA; (6) delta-17 desaturases that catalyze the conversion of ARA to EPA and/or DGLA to ETA; and (7) delta-9 desaturases that catalyze the conversion of palmitic acid to palmitoleic acid (16:1) and/or stearic acid to oleic acid (18:1). In the art, delta-15 and delta-17 desaturases are also occasionally referred to as "omega-3 desaturases", "ω-3 desaturases", and/or "ω-3 desaturases", based on their ability to convert omega-6 fatty acids into their omega-3 counterparts (e.g., conversion of LA into ALA and ARA into EPA, respectively). In some embodiments, it is most desirable to empirically determine the specificity of a particular fatty acid desaturase by transforming a suitable host with the gene for the fatty acid desaturase and determining its effect on the fatty acid profile of the host.

In addition to the desaturases, of particular interest herein are plant fatty acid modifying enzymes that can produce any of the "unusual fatty acids" described above.

The term "PUFA biosynthetic pathway" refers to a metabolic process that converts oleic acid to LA, EDA, GLA, DGLA, ARA, ALA, STA, ETrA (ERA), ETA, EPA, DPA and DHA. This process is well described in the literature (e.g., see PCT Publication No. WO 2006/052870). Simplistically, this process involves elongation of the carbon chain through the addition of carbon atoms and desaturation of the molecule through the addition of double bonds, via a series of special desaturation and elongation enzymes (i.e., "PUFA biosynthetic pathway enzymes") present in the endoplasmic reticulim membrane. More specifically, "PUFA biosynthetic pathway enzyme" refers to any of the following enzymes (and genes which encode said enzymes) associated with the biosynthesis of a PUFA, including: a delta-4 desaturase, a delta-5 desaturase, a delta-6 desaturase, a delta-12 desaturase, a delta-15 desaturase, a delta-17 desaturase, a delta-9 desaturase, a delta-8 desaturase, a delta-9 elongase, a $C_{14/16}$ elongase, a $C_{16/18}$ elongase, a $C_{18/20}$ elongase and/or a $C_{20/22}$ elongase.

The term "elongase system" refers to a suite of four enzymes that are responsible for elongation of a fatty acid carbon chain to produce a fatty acid that is two carbons longer than the fatty acid substrate that the elongase system acts upon. More specifically, the process of elongation occurs in association with fatty acid synthase, whereby CoA is the acyl carrier (Lassner et al., Plant Cell 8:281-292 (1996)). In the first step, which has been found to be both substrate-specific and also rate-limiting, malonyl-CoA is condensed with a long-chain acyl-CoA to yield carbon dioxide ($CO_2$) and a b-ketoacyl-CoA (where the acyl moiety has been elongated by two carbon atoms). Subsequent reactions include reduction to b-hydroxyacyl-CoA, dehydration to an enoyl-CoA and a second reduction to yield the elongated acyl-CoA. Examples of reactions catalyzed by elongase systems are the conversion of GLA to DGLA, STA to ETA, LA to EDA, ALA to ETRA and EPA to DPA.

The term "fatty acid conjugase" in the context of this invention refers to an enzyme that catalyzes the introduction into a fatty acid of at least two double bonds separated by a single bond. Examples of fatty acid conjugases include, but are not limited to: SEQ ID NO: 86, 88, 90, 92, 94, 96, 99, 101, 103, and 105.

The term "acetylenase" in the context of this invention refers to an enzyme that facilitates the introduction of a triple bond into a fatty acid. Examples of acetylenases include, but are not limited to the sequence from Crepins alpine with NCBI General Identification No.:17366029.

The term "hydroxylase" in the context of this invention refers to an enzyme that facilitates the introduction of one or more hydroxyl groups into a compound (e.g. fatty acid) thereby oxidizing it. An examples of a hydroxylase includes, but is not limited to: SEQ ID NO:97.

The term "epoxidase" in the context of this invention refers to an enzyme that catalyzes the insertion of an oxygen molecule into a carbon-carbon double bond to form an epoxide. An example of an expoxidase includes, but is not limited to: SEQ ID NO:80.

The term "multizyme" in the context of this invention refers to a single polypeptide having at least two independent and separable enzymatic activities, wherein the at least two activities are selected from the group consisting of: delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18/20 elongase, a C20/22 elongase, a DGAT, a MBOAT, a fatty acid conjugase, a hydroxylase, an acetylenase, and an epoxidase activity. Preferably, the multizyme comprises a first enzymatic activity linked to a second enzymatic activity.

The term "fusion protein" is used interchangeably with the term "multizyme". Thus, a "fusion protein" refers to a single polypeptide having at least two independent and separable enzymatic activities.

The term "fusion gene" refers to a polynucleotide or gene that encodes a multizyme. A fusion gene can be constructed by linking at least two DNA fragments, wherein each DNA fragment encodes for an independent and separate enzyme activity. An example of a fusion gene has been described in Published U.S. Patent Application No. 2008/0254191, in which a fusion gene was constructed by linking a delta-9 elongase (D9Elo) and a delta-8 desaturase using a linker. Similarly fusion genes can be constructed by one skilled in the art with at least two of the polypeptides selected from the group consisting of: delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18/20 elongase, a C20/22 elongase, a DGAT, a MBOAT, a fatty acid conjugase, a hydroxylase and an epoxidase.

One skilled in the art will be able to identify various candidate genes encoding each of the enzymes desired. Useful desaturase and elongase sequences may be derived from any source, e.g., isolated from a natural source (from bacteria, algae, fungi, plants, animals, etc.), produced via a semi-synthetic route or synthesized de novo. Although the particular source of the desaturase and elongase genes introduced into the host is not critical, considerations for choosing a specific polypeptide having desaturase or elongase activity include: (1) the substrate specificity of the polypeptide; (2) whether the polypeptide or a component thereof is a rate-limiting enzyme; (3) whether the desaturase or elongase is essential for synthesis of a desired PUFA; and/or (4) co-factors required by the polypeptide. The expressed polypeptide preferably has parameters compatible with the biochemical environment of its location in the host cell (see PCT Publication No. WO 2004/101757 for additional details).

In additional embodiments, it will also be useful to consider the conversion efficiency of each particular desaturase and/or elongase. More specifically, since each enzyme rarely functions with 100% efficiency to convert substrate to product, the final lipid profile of unpurified oils produced in a host cell will typically be a mixture of various PUFAs consisting of the desired omega-3/omega-6 fatty acid, as well as various upstream intermediary PUFAs. Thus, consideration of each enzyme's conversion efficiency is also a variable when optimizing biosynthesis of a desired fatty acid that must be considered in light of the final desired lipid profile of the product.

With each of the considerations above in mind, candidate genes having the appropriate desaturase and elongase activities (e.g., delta-6 desaturases, $C_{18/20}$ elongases, delta-5 desaturases, delta-17 desaturases, delta-15 desaturases, delta-9 desaturases, delta-12 desaturases, $C_{14/16}$ elongases, $C_{16/18}$ elongases, delta-9 elongases, delta-8 desaturases, delta-4 desaturases and $C_{20/22}$ elongases) can be identified according to publicly available literature (e.g., GenBank), the patent literature, and experimental analysis of organisms having the ability to produce PUFAs. These genes will be suitable for introduction into a specific host organism, to enable or enhance the organism's synthesis of PUFAs.

The terms "conversion efficiency" and "percent substrate conversion" refer to the efficiency by which a particular enzyme (e.g., a desaturase) can convert substrate to product. The conversion efficiency is measured according to the following formula: ([product]/[substrate+product])*100, where 'product' includes the immediate product and all products in the pathway derived from it.

"Microbial oils" or "single cell oils" are those oils naturally produced by microorganisms (e.g., algae, oleaginous yeasts and filamentous fungi) during their lifespan. The term "oil" refers to a lipid substance that is liquid at 25° C. and usually polyunsaturated. In contrast, the term "fat" refers to a lipid substance that is solid at 25° C. and usually saturated.

"Lipid bodies" refer to lipid droplets that usually are bounded by specific proteins and a monolayer of phospholipid. These organelles are sites where most organisms transport/store neutral lipids. Lipid bodies are thought to arise from microdomains of the endoplasmic reticulum that contain TAG-biosynthesis enzymes, and their synthesis and size appear to be controlled by specific protein components.

"Neutral lipids" refer to those lipids commonly found in cells in lipid bodies as storage fats and oils and are so called, because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or TAG, respectively (or collectively, acylglycerols). A hydrolysis reaction must occur to release free fatty acids from acylglycerols.

The terms "triacylglycerol", "oil" and "TAGs" refer to neutral lipids composed of three fatty acyl residues esterified to a glycerol molecule (and such terms will be used interchangeably throughout the present disclosure herein). Such oils can contain long chain PUFAs, as well as shorter saturated and unsaturated fatty acids and longer chain saturated fatty acids. Thus, "oil biosynthesis" generically refers to the synthesis of TAGs in the cell.

The term "DAG AT" or "DGAT" refers to a diacylglycerol acyltransferase (also known as an acyl-CoA-diacylglycerol acyltransferase or a diacylglycerol O-acyltransferase) (EC 2.3.1.20). This enzyme is responsible for the conversion of acyl-CoA and 1,2-diacylglycerol to TAG and CoA (thereby involved in the terminal step of TAG biosynthesis). Two families of DAG AT enzymes exist: DGAT1 and DGAT2. The former family shares homology with the acyl-CoA:cholesterol acyltransferase (ACAT) gene family, while the latter family is unrelated (Lardizabal et al., *J. Biol. Chem.* 276(42): 38862-28869 (2001)).

The term "MBOAT" refers to membrane bound O-acyltransferase family of proteins.

As used herein, "nucleic acid" means a polynucleotide and includes single or double-stranded polymer of deoxyribonucleotide or ribonucleotide bases. Nucleic acids may also include fragments and modified nucleotides. Thus, the terms "polynucleotide", "nucleic acid sequence", "nucleotide sequence" or "nucleic acid fragment" are used interchangeably and is a polymer of RNA or DNA that is single- or double-stranded, optionally containing synthetic, non-natural or altered nucleotide bases. Nucleotides (usually found in their 5'-monophosphate form) are referred to by their single letter designation as follows: "A" for adenylate or deoxyadenylate (for RNA or DNA, respectively), "C" for cytidylate or deosycytidylate, "G" for guanylate or deoxyguanylate, "U" for uridlate, "T" for deosythymidylate, "R" for purines (A or G), "Y" for pyrimidiens (C or T), "K" for G or T, "H" for A or C or T, "I" for inosine, and "N" for any nucleotide.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric genes to produce the desired phenotype in a transformed plant. Chimeric genes can be designed for use in suppression by linking a nucleic acid fragment or subfragment thereof, whether or not it encodes an active enzyme, in the sense or antisense orientation relative to a plant promoter sequence.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

The terms "homology", "homologous", "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that substantially similar nucleic acid sequences encompassed by this invention are also defined by their ability to hybridize (under moderately stringent conditions, e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$ can be approximated from the equation of Meinkoth et al., *Anal. Biochem.* 138:267-284 (1984): $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≥90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, N.Y. (1993); and *Current Protocols in Molecular Biology*, Chapter 2, Ausubel et al., Eds., Greene Publishing and Wiley-Interscience, New York (1995). Hybridization and/or wash conditions can be applied for at least 10, 30, 60, 90, 120, or 240 minutes.

"Sequence identity" or "identity" in the context of nucleic acid or polypeptide sequences refers to the nucleic acid bases or amino acid residues in two sequences that are the same when aligned for maximum correspondence over a specified comparison window. Thus, "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, or 95%, or any integer percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, CABIOS. 5:151-153 (1989); Higgins, D. G. et al. (1992) *Comput. Appl. Biosci.* 8:189-191) and found in the MegAlign™ program of the LASERGENE bioinformatics computing suite (DNASTAR Inc., Madison, Wis.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

"BLASTN method of alignment" is an algorithm provided by the National Center for Biotechnology Information (NCBI) to compare nucleotide sequences using default parameters.

It is well understood by one skilled in the art that many levels of sequence identity are useful in identifying polypeptides, from other species, wherein such polypeptides have the same or similar function or activity. Useful examples of percent identities include, but are not limited to, 50%, 55%, 60%, 65%, 70%, 75%, 80%, 85%, 90%, or 95%, or any integer percentage from 50% to 100%. Indeed, any integer amino acid identity from 50% to 100% may be useful in describing the present invention, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Also, of interest is any full-length or partial complement of this isolated nucleotide fragment.

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

The term "genome" as it applies to a plant cells encompasses not only chromosomal DNA found within the nucleus, but organelle DNA found within subcellular components (e.g., mitochondrial, plastid) of the cell.

A "codon-optimized gene" is a gene having its frequency of codon usage designed to mimic the frequency of preferred codon usage of the host cell.

An "allele" is one of several alternative forms of a gene occupying a given locus on a chromosome. When all the alleles present at a given locus on a chromosome are the same that plant is homozygous at that locus. If the alleles present at a given locus on a chromosome differ that plant is heterozygous at that locus.

"Coding sequence" refers to a DNA sequence that codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to: promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity. Promoters that cause a gene to be expressed in most cell types at most times are commonly referred to as "constitutive promoters". New promoters of various types useful in plant cells are constantly being discovered; numerous examples may be found in the compilation by Okamuro, J. K., and Goldberg, R. B. *Biochemistry of Plants* 15:1-82 (1989).

"Translation leader sequence" refers to a polynucleotide sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D., *Mol. Biotechnol.* 3:225-236 (1995)).

"3' non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht, I. L., et al. *Plant Cell* 1:671-680 (1989).

"RNA transcript" refers to the product resulting from RNA polymerase-catalyzed transcription of a DNA sequence. When the RNA transcript is a perfect complementary copy of the DNA sequence, it is referred to as the primary transcript. An RNA transcript is referred to as the mature RNA when it is an RNA sequence derived from post-transcriptional processing of the primary transcript. "Messenger RNA" or "mRNA" refers to the RNA that is without introns and that can be translated into protein by the cell. "cDNA" refers to a DNA that is complementary to, and synthesized from, an mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions of the invention can be operably linked, either directly or indirectly, 5' to the target mRNA, or 3' to the target mRNA, or within the target mRNA, or a first complementary region is 5' and its complement is 3' to the target mRNA.

Standard recombinant DNA and molecular cloning techniques used herein are well known in the art and are described more fully in Sambrook, J., Fritsch, E. F. and Maniatis, T. Molecular Cloning: A Laboratory Manual; Cold Spring Harbor Laboratory: Cold Spring Harbor, N.Y. (1989) (hereinafter "Sambrook et al., 1989"). Transformation methods are well known to those skilled in the art and are described infra.

"PCR" or "polymerase chain reaction" is a technique for the synthesis of large quantities of specific DNA segments and consists of a series of repetitive cycles (Perkin Elmer Cetus Instruments, Norwalk, Conn.). Typically, the double-stranded DNA is heat denatured, the two primers complementary to the 3' boundaries of the target segment are annealed at low temperature and then extended at an intermediate temperature. One set of these three consecutive steps is referred to as a "cycle".

The term "recombinant" refers to an artificial combination of two otherwise separated segments of sequence, e.g., by chemical synthesis or by the manipulation of isolated segments of nucleic acids by genetic engineering techniques.

The terms "plasmid", "vector" and "cassette" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host (i.e., to a discrete nucleic acid fragment into which a nucleic acid sequence or fragment can be moved).

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., *EMBO J.* 4:2411-2418 (1985); De Almeida et al., *Mol. Gen. Genetics* 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

The term "expression", as used herein, refers to the production of a functional end-product (e.g., a mRNA or a protein [either precursor or mature]).

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid fragment (e.g., a recombinant DNA construct/expression construct) into a cell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid or mitochondrial DNA), converted into an autonomous replicon, or transiently expressed (e.g., transfected mRNA).

"Mature" protein refers to a post-translationally processed polypeptide (i.e., one from which any pre- or propeptides present in the primary translation product have been removed). "Precursor" protein refers to the primary product of translation of mRNA (i.e., with pre- and propeptides still present). Pre- and propeptides may be but are not limited to intracellular localization signals.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or DNA-containing organelle, of a host organism resulting in gene expression without integration or stable inheritance. Host organisms containing the transformed nucleic acid fragments are referred to as "transgenic" organisms.

As used herein, "transgenic" refers to a plant or a cell which comprises within its genome a heterologous polynucleotide. Preferably, the heterologous polynucleotide is stably integrated within the genome such that the polynucleotide is passed on to successive generations. The heterologous polynucleotide may be integrated into the genome alone or as part of an expression construct. Transgenic is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation. "Antisense inhibition" refers to the production of antisense RNA transcripts capable of suppressing the expression of the target protein. "Co-suppression" refers to the production of sense RNA transcripts capable of suppressing the expression of identical or substantially similar foreign or endogenous genes (U.S. Pat. No. 5,231,020). Co-suppression constructs in plants previously have been designed by focusing on overexpression of a nucleic acid sequence having homology to an endogenous mRNA, in the sense orientation, which results in the reduction of all RNA having homology to the overexpressed sequence (Vaucheret et al., Plant J. 16:651-659 (1998); Gura, Nature 404:804-808 (2000)). The overall efficiency of this phenomenon is low, and the extent of the RNA reduction is widely variable. More recent work has described the use of "hairpin" structures that incorporate all, or part, of an mRNA encoding sequence in a complementary orientation that results in a potential "stem-loop" structure for the expressed RNA (PCT Publication No. WO 99/53050; PCT Publication No. WO 02/00904). This increases the frequency of co-suppression in the recovered transgenic plants. Another variation describes the use of plant viral sequences to direct the suppression, or "silencing", of proximal mRNA encoding sequences (PCT Publication No. WO 98/36083). Both of these co-suppressing phenomena have not been elucidated mechanistically, although genetic evidence has begun to unravel this complex situation (Elmayan et al., Plant Cell 10:1747-1757 (1998)).

The term "oleaginous" refers to those organisms that tend to store their energy source in the form of lipid (Weete, In: Fungal Lipid Biochemistry, $2^{nd}$ Ed., Plenum, 1980). A class of plants identified as oleaginous are commonly referred to as "oilseed" plants. Examples of oilseed plants include, but are not limited to: soybean (Glycine and *Soja* sp.), flax (*Linum* sp.), rapeseed (*Brassica* sp.), maize, cotton, safflower (*Carthamus* sp.) and sunflower (*Helianthus* sp.).

The term "plant" refers to whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores.

"Progeny" comprises any subsequent generation of a plant.

"Non-transgenic, null segregant soybean seed" refers to a near isogenic plant or seed that lacks the transgene, and/or a parental plant used in the transformation process to obtain the transgenic event. Null segregants can be plants or seed that do not contain the transgenic trait due to normal genetic segregation during propagation of the heterozygous transgenic plants.

A "kernel" is the corn caryopsis, consisting of a mature embryo and endosperm which are products of double fertilization. The term "corn" or "maize" represents any variety, cultivar, or population of *Zea mays* L.

"Grain" comprises mature corn kernels produced by commercial growers for on farm use or for sale to customers in both cases for purposes other than growing or reproducing the species. The "seed" is the mature corn kernel produced for the purpose of propagating the species and for sale to commercial growers. As used herein the terms seeds, kernels, and grains can be used interchangeably. The "embryo" or also termed "germ" is a young sporophytic plant, before the start of a period of rapid growth (seed germination). The embryo (germ) of corn contains the vast majority of the oil found in the kernel. The structure of embryo in cereal grain includes the embryonic axis and the scutellum. The "scutellum" is the single cotyledon of a cereal grain embryo, specialized for absorption of the endosperm.

The "aleurone" is a proteinaceous material, usually in the form of small granules, occurring in the outermost cell layer of the endosperm of corn and other grains.

The present invention concerns a method for increasing the content of at least one unusual fatty acid in an oilseed plant cell comprising:

(a) transforming the oilseed plant with:
  (i) a first recombinant DNA construct comprising an isolated polynucleotide encoding at least one DGAT polypeptide or at least one MBOAT polypeptide operably linked to at least one regulatory sequence; and
  (ii) at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a Ca6/18 elongase, a C18/20 elongase, a C20/22 elongase, a DGAT, an MBOAT, a fatty acid conjugase, a hydroxylase, an acetylenase, an epoxidase and a multizyme;
(b) regenerating an oilseed plant from the transformed cell of step (a); and (c) selecting those seeds obtained from the plants of step (b) having an increased level of at least one unusual fatty acid when compared to the level in seeds obtained from a transgenic plant comprising at least one recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18/20 elongase, a C20/22 elongase, a DGAT, an MBOAT, a fatty acid conjugase, a hydroxylase, an acetylenase, an epoxidase and a multizyme.

The present invention furthermore concerns an isolated polynucleotide comprising a nucleotide sequence encoding a polypeptide with MBOAT activity, wherein, based on the Clustal V method of alignment with pairwise alignment default parameters of KTUPLE=1, GAP PENALTY=3, WINDOW=5 and DIAGONALS SAVED=5, the polypeptide has an amino acid sequence of at least 80%, 85%, 90%, 95%, or 100% sequence identity when compared to SEQ ID NO:3, 12, 123, 126, or 137; or the full complement of the nucleotide sequence.

Another embodiment of the present invention comprises an isolated polynucleotide comprising a nucleotide sequence encoding a polypeptide with DGAT activity, wherein, based on the Clustal V method of alignment with pairwise alignment default parameters of KTUPLE=1, GAP PENALTY=3, WINDOW=5 and DIAGONALS SAVED=5, the polypeptide has an amino acid sequence of at least 80%, 85%, 90%, 95%, or 100% sequence identity when compared to SEQ ID NO:15 or 26; or the full complement of the nucleotide sequence.

Recombinant DNA constructs comprising the polynucleotides of the present invention are also part of the embodiments.

Furthermore host cells comprising in its genome any of the recombinant constructs of the present invention are part of the embodiments. The host cell can be a plant cell, a microbial cell or a yeast cell. Useful oilseed host plants comprise, but are not limited to soybean, *Brassica* species, sunflower, maize, cotton, flax, and safflower.

Another embodiment of the present invention comprises a method for increasing at least one conversion efficiency, wherein said conversion efficiency is at least one selected from the group consisting of: $C_{18}$ to $C_{20}$ elongation, delta-6 desaturation, the delta-9 elongation, delta-8 desaturation, conjugation to Eleostearic acid and conjugation to Calendic acid, in an oilseed plant cell comprising a first recombinant DNA construct comprising an isolated polynucleotide encoding at least one MBOAT polypeptide operably linked to at least one regulatory sequence; and at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18/20 elongase, a C20122 elongase, a DGAT, an MBOAT, a fatty acid conjugase, a hydroxylase, an acetylenase, an epoxidase and a multizyme; regenerating an oilseed plant from the transformed cell; and selecting those seeds obtained from the plants of the regenerating step having at least one increase in conversion efficiency, wherein said increase in conversion efficiency is at least one selected from the group consisting of: $C_{18}$ to $C_{20}$ elongation, delta-6 desaturation, the delta-9 elongation, delta-8 desaturation, conjugation to Eleostearic acid and conjugation to Calendic acid, when compared to the level in seeds obtained from a transgenic plant comprising at least one recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18/20 elongase and a C20/22 elongase, a DGAT, an MBOAT, a fatty acid conjugase, a hydroxylase, an acetylenase, an epoxidase and a multizyme.

Furthermore, the present invention concerns methods to increase the $C_{18}$ to $C_{20}$ elongation conversion efficiency at least 1.1, 1.2, 1.3, 1.4, 1.5, 1.6, 1.7, 1.8, 1.8, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.2, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, 10.0, 10.1, 10.2, 10.3, 10.4, 10.5, 10.6, 10.7, 10.8, 10.9, 11-fold and the delta-6 desaturation conversion efficiency is increased at least 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.2, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, 10.0, 10.1, 10.2, 10.3, 10.4, 10.5, 10.6, 10.7, 10.8, 10.9, 11-fold; or the delta-9 elongation conversion efficiency is increased by at least 1.1, 1.2, 1.3, 1.4, 1.5, 1.6, 1.7, 1.8, 1.8, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.2, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, 10.0, 10.1, 10.2, 10.3, 10.4, 10.5, 10.6, 10.7, 10.8, 10.9, 11-fold and the delta-8 desaturation conversion efficiency is increased by at least 1.2, 1.3, 1.4, 1.5, 1.6, 1.7, 1.8, 1.8, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.2, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, 10.0, 10.1, 10.2, 10.3, 10.4, 10.5, 10.6, 10.7, 10.8, 10.9, 11-fold; or the conjugation conversion efficiency to Eleostearic acid is at least 1.2, 1.3, 1.4, 1.5, 1.6, 1.7, 1.8, 1.8, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.2, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, 10.0, 10.1, 10.2, 10.3, 10.4, 10.5, 10.6, 10.7, 10.8, 10.9, 11-fold; or the conjugation conversion efficiency to Calendic acid is at least 2.5, 2.6, 2.7, 2.8, 2.9, 3.0, 3.1, 3.2, 3.3, 3.4, 3.5, 3.6, 3.7, 3.8, 3.9, 4.0, 4.2, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, 10.0, 10.1, 10.2, 10.3, 10.4, 10.5, 10.6, 10.7, 10.8, 10.9, 11-fold.

Another embodiment of the invention concerns a method for increasing the content of at least one unusual fatty acid in an oilseed plant cell comprising a first recombinant DNA construct comprising an isolated polynucleotide encoding at least one DGAT polypeptide operably linked to at least one regulatory sequence; and at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18120 elongase, a C20/22 elongase, a DGAT, an MBOAT, a fatty acid conjugase, a hydroxylase, an acetylenase, an epoxidase and a multizyme; regeneating an oilseed plant from the transformed cell and selecting those seeds obtained from the plants of the regenerating step having an increased level of at least one unusual fatty acid when compared to the level in seeds obtained from a transgenic plant comprising at least one recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18120 elongase, a C20/22 elongase, a DGAT, an MBOAT, a fatty acid conjugase, a hydroxylase, an acetylenase, an epoxidase and a multizyme.

Unusual fatty acids of particular interest include, but are not limited to, GLA, STA, EDA, ERA, DGLA, ETA, ELEO and CAL.

Suitable oilseed plants to practice the invention include, but are not limited to, soybean, *Brassica* species, sunflower, maize, cotton, flax and safflower.

Seeds and oils obtained from the transgenic plants or seeds of the invention are also of interest, as are feed and food incorporating the seeds or oils of the invention.

A transgenic oilseed of the invention can comprise a recombinant construct having at least one MBOAT and/or DGAT sequence. This DGAT sequence can be selected from the group consisting of DGAT1, DGAT2 and DGAT1 in combination with DGAT2. Furthermore, at least one DGAT sequence can be from *Yarrowia*. Examples of suitable MBOAT and DGAT sequences that can be used to practice the invention are discussed in the Examples below. Those skilled in the art will appreciate that the instant invention includes, but is not limited to, the MBOAT and DGAT sequences disclosed herein. Furthermore, the transgenic oilseed of the invention can comprise a recombinant constructs having at least one MBOAT and/or DGAT sequence and at least one additional recombinant construct comprising an isolated polynucleotide, operably linked to at lest one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16118 elongase, a C18/20 elongase, a C20/22 elongase, a fatty acid conjugase, a hydroxylase, an acetylenase, an epoxidase and a multizyme.

Such a recombinant construct would comprise different components such as a promoter which is a DNA sequence that directs cellular machinery of a plant to produce RNA from the contiguous coding sequence downstream (3') of the promoter. The promoter region influences the rate, developmental stage, and cell type in which the RNA transcript of the gene is made. The RNA transcript is processed to produce mRNA which serves as a template for translation of the RNA sequence into the amino acid sequence of the encoded polypeptide. The 5' non-translated leader sequence is a region of the mRNA upstream of the protein coding region that may play a role in initiation and translation of the mRNA. The 3' transcription termination/polyadenylation signal is a non-translated region downstream of the protein coding region that functions in the plant cell to cause termination of the RNA transcript and the addition of polyadenylate nucleotides to the 3' end of the RNA.

The origin of the promoter chosen to drive expression of the coding sequences of the invention is not important as long as it has sufficient transcriptional activity to accomplish the invention by expressing translatable mRNA for the desired nucleic acid fragments in the desired host tissue at the right time. Either heterologous or non-heterologous (i.e., endogenous) promoters can be used to practice the invention. For example, suitable promoters include, but are not limited to: the alpha prime subunit of beta conglycinin promoter, the Kunitz trypsin inhibitor 3 promoter, the annexin promoter, the glycinin Gy1 promoter, the beta subunit of beta conglycinin promoter, the P34/Gly Bd m 30K promoter, the albumin promoter, the Leg A1 promoter and the Leg A2 promoter.

The annexin, or P34, promoter is described in PCT Publication No. WO 2004/071178. The level of activity of the annexin promoter is comparable to that of many known strong promoters, such as: (1) the CaMV 35S promoter (Atanassova et al., *Plant Mol. Biol.* 37:275-285 (1998); Battraw and Hall, *Plant Mol. Biol.* 15:527-538 (1990); Holtorf et al., *Plant Mol. Biol.* 29:637-646 (1995); Jefferson et al., *EMBO J.* 6:3901-3907 (1987); Wilmink et al., *Plant Mol. Biol.* 28:949-955 (1995)); (2) the *Arabidopsis oleosin* promoters (Plant et al., *Plant Mol. Biol.* 25:193-205 (1994); Li, Texas A&M University Ph.D. dissertation, pp. 107-128 (1997)); (3) the *Arabidopsis* ubiquitin extension protein promoters (Callis et al., *J. Biol. Chem.* 265(21):12486-93 (1990)); (4) a tomato ubiquitin gene promoter (Rollfinke et al., *Gene.* 211(2):267-76 (1998)); (5) a soybean heat shock protein promoter (Schoffl et al., *Mol Gen Genet.* 217(2-3):246-53 (1989)); and, (6) a maize H3 histone gene promoter (Atanassova et al., *Plant Mot Biol.* 37(2):275-85 (1989)).

Another useful feature of the annexin promoter is its expression profile in developing seeds. The annexin promoter is most active in developing seeds at early stages (before 10 days after pollination) and is largely quiescent in later stages. The expression profile of the annexin promoter is different from that of many seed-specific promoters, e.g., seed storage protein promoters, which often provide highest activity in later stages of development (Chen et al., *Dev. Genet.* 10:112-122 (1989); Ellerstrom et al., *Plant Mol. Biol.* 32:1019-1027 (1996); Keddie et al., *Plant Mol. Biol.* 24:327-340 (1994); Plant et al., (supra); Li, (supra)). The annexin promoter has a more conventional expression profile but remains distinct from other known seed specific promoters. Thus, the annexin promoter will be a very attractive candidate when overexpression, or suppression, of a gene in embryos is desired at an early developing stage. For example, it may be desirable to overexpress a gene regulating early embryo development or a gene involved in the metabolism prior to seed maturation.

Following identification of an appropriate promoter suitable for expression of a specific coding sequence of the invention, the promoter is then operably linked in a sense orientation using conventional means well known to those skilled in the art.

Standard recombinant DNA and molecular cloning techniques used herein are well known in the art and are described more fully in Sambrook et al., 1989 or Ausubel, F. M., Brent, R., Kingston, R. E., Moore, D. D., Seidman, J. G., Smith, J. A.

and Struhl, K., Eds.; In *Current Protocols in Molecular Biology*; John Wiley and Sons: New York, 1990.

Once the recombinant construct has been made, it may then be introduced into a plant cell of choice by methods well known to those of ordinary skill in the art (e.g., transfection, transformation and electroporation). Oilseed plant cells are the preferred plant cells. The transformed plant cell is then cultured and regenerated under suitable conditions permitting selection of those transformed soybean cell(s).

Such recombinant constructs may be introduced into one plant cell or, alternatively, each construct may be introduced into separate plant cells.

Expression in a plant cell may be accomplished in a transient or stable fashion as is described above.

Also within the scope of this invention are seeds or plant parts obtained from such transformed plants.

Plant parts include differentiated and undifferentiated tissues including, but not limited to, the following: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or a group of tissues that constitute a morphologically and functionally distinct part of a plant. The term "genome" refers to the following: (1) the entire complement of genetic material (genes and non-coding sequences) that is present in each cell of an organism, or virus or organelle; and/or (2) a complete set of chromosomes inherited as a (haploid) unit from one parent.

Methods for transforming dicots (primarily by use of *Agrobacterium tumefaciens*) and obtaining transgenic plants have been published, among others, for: cotton (U.S. Pat. No. 5,004,863; U.S. Pat. No. 5,159,135); soybean (U.S. Pat. No. 5,569,834; U.S. Pat. No. 5,416,011); *Brassica* (U.S. Pat. No. 5,463,174); peanut (Cheng et al. *Plant Cell Rep.* 15:653-657 (1996); McKently et al. *Plant Cell Rep.* 14:699-703 (1995)); papaya (Ling, K. et al. *Bio/technology* 9:752-758 (1991)); and pea (Grant et al. *Plant Cell Rep.* 15:254-258 (1995)). For a review of other commonly used methods of plant transformation see Newell, C. A. (*Mol. Biotechnol.* 16:53-65 (2000)). One of these methods of transformation uses *Agrobacterium rhizogenes* (Tepfler, M. and Casse-Delbart, F. *Microbiol. Sci.* 4:24-28 (1987)). Transformation of soybeans using direct delivery of DNA has been published using PEG fusion (PCT Publication No. WO 92/17598), electroporation (Chowrira, G. M. et al., *Mol. Biotechnol.* 3:17-23 (1995); Christou, P. et al., *Proc. Natl. Acad. Sci. U.S.A.* 84:3962-3966 (1987)), microinjection and particle bombardement (McCabe, D. E. et. al., *Bio/Technology* 6:923 (1988); Christou et al., *Plant Physiol.* 87:671-674 (1988)).

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well known in the art (Weissbach and Weissbach, In: Methods for Plant Molecular Biology, (Eds.), Academic: San Diego, Calif. (1988)). This regeneration and growth process typically includes the steps of selection of transformed cells and culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

In addition to the above discussed procedures, practitioners are familiar with the standard resource materials which describe specific conditions and procedures for: the construction, manipulation and isolation of macromolecules (e.g., DNA molecules, plasmids, etc.); the generation of recombinant DNA fragments and recombinant expression constructs; and, the screening and isolating of clones. See, for example: Sambrook et al., 1989; Maliga et al., Methods in Plant Molecular Biology, Cold Spring Harbor: NY (1995); Birren et al., Genome Analysis: Detecting Genes, Vol. 1, Cold Spring Harbor: NY (1998); Birren et al., Genome Analysis: Analyzing DNA, Vol. 2, Cold Spring Harbor: NY (1998); Plant Molecular Biology: A Laboratory Manual, eds. Clark, Springer: NY (1997).

Transformation of monocotyledons using electroporation, particle bombardment, and *Agrobacterium* have been reported. Transformation and plant regeneration have been achieved in asparagus (Bytebier et al., *Proc. Natl. Acad. Sci.* (USA) 84:5354, (1987)); barley (Wan and Lemaux, *Plant Physiol* 104:37 (1994)); *Zea mays* (Rhodes et al., *Science* 240:204 (1988), Gordon-Kamm et al., *Plant Cell* 2:603-618 (1990), Fromm et al., *Bio/Technology* 8:833 (1990), Koziel et al., *Bio/Technology* 11: 194, (1993), Armstrong et al., *Crop Science* 35:550-557 (1995)); oat (Somers et al., *Bio/Technology* 10: 15 89 (1992)); orchard grass (Horn et al., *Plant Cell Rep.* 7:469 (1988)); rice (Toriyama et al., *TheorAppl. Genet.* 205:34, (1986); Part et al., *Plant Mol. Biol.* 32:1135-1148, (1996); Abedinia et al., *Aust. J. Plant Physiol.* 24:133-141 (1997); Zhang and Wu, *Theor. Appl. Genet.* 76:835 (1988); Zhang et al. *Plant Cell Rep.* 7:379, (1988); Battraw and Hall, *Plant Sci.* 86:191-202 (1992); Christou et al., *Bio/Technology* 9:957 (1991)); rye (De la Pena et al., *Nature* 325:274 (1987)); sugarcane (Bower and Birch, *Plant J.* 2:409 (1992)); tall fescue (Wang et al., *Bio/Technology* 10:691 (1992)), and wheat (Vasil et al., *Bio/Technology* 10:667 (1992); U.S. Pat. No. 5,631,152).

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454-457 (1988); Marcotte et al., *Plant Cell* 1:523-532 (1989); McCarty et al., *Cell* 66:895-905 (1991); Hattori et al., *Genes Dev.* 6:609-618 (1992); Goff et al., *EMBO J.* 9:2517-2522 (1990)).

Transient expression systems may be used to functionally dissect gene constructs (see generally, Maliga et al., Methods in Plant Molecular Biology, Cold Spring Harbor Press (1995)). It is understood that any of the nucleic acid molecules of the present invention can be introduced into a plant cell in a permanent or transient manner in combination with other genetic elements such as vectors, promoters, enhancers etc.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones (see for example, Sambrook et al., 1989; Maliga et al., Methods in Plant Molecular Biology, Cold Spring Harbor Press (1995); Birren et al., Genome Analysis Detecting Genes, 1, Cold Spring Harbor, N.Y. (1998); Birren et al., Genome Analysis: Analyzing DNA, 2, Cold Spring Harbor, N.Y. (1998); Plant Molecular Biology: A Laboratory Manual, eds. Clark, Springer, N.Y. (1997)).

The transgenic oilseeds of the invention can be processed to yield oil, protein products and/or by-products that are derivatives obtained by processing that have commercial value. One example, of many, useful for illustrating this point are transgenic soybean seeds of the invention which can be processed to yield soy oil, soy products and/or soy by-products.

"Soy products" can include, but are not limited to, those items listed in Table 1A.

TABLE 1A

Soy Protein Products Derived from Soybean Seeds[a]

Whole Soybean Products

Roasted Soybeans
Baked Soybeans
Soy Sprouts
Soy Milk
Processed Soy Protein Products Full Fat and Defatted Flours
Soy Grits
Soy Hypocotyls
Soybean Meal
Soy Milk
Soy Protein Isolates
Soy Protein Concentrates
Textured Soy Proteins
Textured Flours and Concentrates
Textured Concentrates
Textured Isolates
Specialty Soy Foods/Ingredients Soy Milk
Tofu
Tempeh
Miso
Soy Sauce
Hydrolyzed Vegetable Protein
Whipping Protein

[a]See Soy Protein Products: Characteristics, Nutritional Aspects and Utilization (1987). Soy Protein Council.

"Processing" refers to any physical and chemical methods used to obtain the products listed in Table 1A and includes, but is not limited to, heat conditioning, flaking and grinding, extrusion, solvent extraction, or aqueous soaking and extraction of whole or partial seeds. Furthermore, "processing" includes the methods used to concentrate and isolate soy protein from whole or partial seeds, as well as the various traditional Oriental methods in preparing fermented soy food products. Trading Standards and Specifications have been established for many of these products (see National Oilseed Processors Association Yearbook and Trading Rules 1991-1992). Products referred to as being "high protein" or "low protein" are those as described by these Standard Specifications. "NSI" refers to the Nitrogen Solubility Index as defined by the American Oil Chemists' Society Method Ac4 41. "KOH Nitrogen Solubility" is an indicator of soybean meal quality and refers to the amount of nitrogen soluble in 0.036 M KOH under the conditions as described by Araba and Dale [(1990) *Poult. Sci.* 69:76-83]. "White" flakes refer to flaked, dehulled cotyledons that have been defatted and treated with controlled moist heat to have an NSI of about 85 to 90. This term can also refer to a flour with a similar NSI that has been ground to pass through a No. 100 U.S. Standard Screen size. "Cooked" refers to a soy protein product, typically a flour, with an NSI of about 20 to 60. "Toasted" refers to a soy protein product, typically a flour, with an NSI below 20. "Grits" refer to defatted, dehulled cotyledons having a U.S. Standard screen size of between No. 10 and 80. "Soy Protein Concentrates" refer to those products produced from dehulled, defatted soybeans by three basic processes: acid leaching (at about pH 4.5), extraction with alcohol (about 55-80%), and denaturing the protein with moist heat prior to extraction with water. Conditions typically used to prepare soy protein concentrates have been described by Pass [(1975) U.S. Pat. No. 3,897,574; Campbell et al., (1985) in New Protein Foods, ed. by Altschul and Wilcke, Academic Press, Vol. 5, Chapter 10, *Seed Storage Proteins*, pp 302-338]. "Extrusion" refers to processes whereby material (grits, flour or concentrate) is passed through a jacketed auger using high pressures and temperatures as a means of altering the texture of the material. "Texturing" and "structuring" refer to extrusion processes used to modify the physical characteristics of the material. The characteristics of these processes, including thermoplastic extrusion, have been described previously [Atkinson (1970) U.S. Pat. No. 3,488,770, Horan (1985) In *New Protein Foods*, ed. by Altschul and Wilcke, Academic Press, Vol. 1A, Chapter 8, pp 367-414]. Moreover, conditions used during extrusion processing of complex foodstuff mixtures that include soy protein products have been described previously [Rokey (1983) *Feed Manufacturing Technology III*, 222-237; McCulloch, U.S. Pat. No. 4,454,804].

TABLE 1B

Generalized Steps for Soybean Oil and Byproduct Production

| Process Step | Process | Impurities Removed and/or By-Products Obtained |
| --- | --- | --- |
| #1 | soybean seed | |
| #2 | oil extraction | meal |
| #3 | Degumming | lecithin |
| #4 | alkali or physical refining | gums, free fatty acids, pigments |
| #5 | water washing | soap |
| #6 | Bleaching | color, soap, metal |
| #7 | (hydrogenation) | |
| #8 | (winterization) | stearine |
| #9 | Deodorization | free fatty acids, tocopherols, sterols, volatiles |
| #10 | oil products | |

More specifically, soybean seeds are cleaned, tempered, dehulled, and flaked, thereby increasing the efficiency of oil extraction. Oil extraction is usually accomplished by solvent (e.g., hexane) extraction but can also be achieved by a combination of physical pressure and/or solvent extraction. The resulting oil is called crude oil. The crude oil may be degummed by hydrating phospholipids and other polar and neutral lipid complexes that facilitate their separation from the nonhydrating, triglyceride fraction (soybean oil). The resulting lecithin gums may be further processed to make commercially important lecithin products used in a variety of food and industrial products as emulsification and release (i.e., antisticking) agents. Degummed oil may be further refined for the removal of impurities (primarily free fatty acids, pigments and residual gums). Refining is accomplished by the addition of a caustic agent that reacts with free fatty acid to form soap and hydrates phosphatides and proteins in the crude oil. Water is used to wash out traces of soap formed during refining. The soapstock byproduct may be used directly in animal feeds or acidulated to recover the free fatty acids. Color is removed through adsorption with a bleaching earth that removes most of the chlorophyll and carotenoid compounds. The refined oil can be hydrogenated, thereby resulting in fats with various melting properties and textures. Winterization (fractionation) may be used to remove stearine from the hydrogenated oil through crystallization under carefully controlled cooling conditions. Deodorization (principally via steam distillation under vacuum) is the last step and is designed to remove compounds which impart odor or flavor to the oil. Other valuable byproducts such as tocopherols and sterols may be removed during the deodorization process. Deodorized distillate containing these byproducts may be sold for production of natural vitamin E and other high-value pharmaceutical products. Refined, bleached, (hydrogenated, fractionated) and deodorized oils and fats may be packaged and sold directly or further processed into more specialized products. A more detailed reference to soybean seed processing, soybean oil production, and byproduct utilization can be found in Erickson, Practical Handbook of Soybean Processing and Utilization, The American Oil Chemists' Society and United Soybean Board (1995). Soybean oil is liquid at room temperature because it is relatively low in saturated fatty acids when compared with oils such as coconut, palm, palm kernel, and cocoa butter.

Plant and microbial oils containing PUFAs that have been refined and/or purified can be hydrogenated, thereby resulting in fats with various melting properties and textures. Many processed fats (including spreads, confectionary fats, hard butters, margarines, baking shortenings, etc.) require varying degrees of solidity at room temperature and can only be produced through alteration of the source oil's physical properties. This is most commonly achieved through catalytic hydrogenation.

Hydrogenation is a chemical reaction in which hydrogen is added to the unsaturated fatty acid double bonds with the aid of a catalyst such as nickel. For example, high oleic soybean oil contains unsaturated oleic, linoleic, and linolenic fatty acids, and each of these can be hydrogenated. Hydrogenation has two primary effects. First, the oxidative stability of the oil is increased as a result of the reduction of the unsaturated fatty acid content. Second, the physical properties of the oil are changed because the fatty acid modifications increase the melting point resulting in a semi-liquid or solid fat at room temperature.

There are many variables which affect the hydrogenation reaction, which in turn alter the composition of the final product. Operating conditions including pressure, temperature, catalyst type and concentration, agitation, and reactor design are among the more important parameters that can be controlled. Selective hydrogenation conditions can be used to hydrogenate the more unsaturated fatty acids in preference to the less unsaturated ones. Very light or brush hydrogenation is often employed to increase stability of liquid oils. Further hydrogenation converts a liquid oil to a physically solid fat. The degree of hydrogenation depends on the desired performance and melting characteristics designed for the particular end product. Liquid shortenings (used in the manufacture of baking products, solid fats and shortenings used for commercial frying and roasting operations) and base stocks for margarine manufacture are among the myriad of possible oil and fat products achieved through hydrogenation. A more detailed description of hydrogenation and hydrogenated products can be found in Patterson, H. B. W., Hydrogenation of Fats and Oils: Theory and Practice. The American Oil Chemists' Society (1994).

Hydrogenated oils have become somewhat controversial due to the presence of trans-fatty acid isomers that result from the hydrogenation process. Ingestion of large amounts of trans-isomers has been linked with detrimental health effects including increased ratios of low density to high density lipoproteins in the blood plasma and increased risk of coronary heart disease.

Oleaginous organisms can be, but are not limited to, *Torulaspora delbrueckii*, *Pichia anomala*, *Debaryomyces hansenii*, *Candida zeylanoides*, *Lipomyces starkeyi*, *Mucor circinelloides*, *Phaffia rhodozyma*, *Rhodotorula glutinis*, *Cryptococcus curvatus*, *Mortierella alpina*, and *Yarrowia lipolytica*.

EXAMPLES

The present invention is further defined in the following Examples, in which parts and percentages are by weight and degrees are Celsius, unless otherwise stated. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions. Thus, various modifications of the invention in addition to those shown and described herein will be apparent to those skilled in the art from the foregoing description. Such modifications are also intended to fall within the scope of the appended claims.

The meaning of abbreviations is as follows: "sec" means second(s), "min" means minute(s), "h" means hour(s), "d" means day(s), "μL" means microliter(s), "mL" means milliliter(s), "L" means liter(s), "μM" means micromolar, "mM" means millimolar, "M" means molar, "mmol" means millimole(s), "μmole" mean micromole(s), "g" means gram(s), "μg" means microgram(s), "ng" means nanogram(s), "U" means unit(s), "bp" means base pair(s) and "kB" means kilobase(s).

Example 1

Identification of Membrane Bound O-Acyltransferase (MBOAT) Homologs from *Calendula officinalis* and *Momordica charantia* and cDNA Libraries cDNA libraries representing mRNAs from developing seeds of *Calendula officinalis* and *Momordica charantia* were prepared and insert cDNA fragments were sequenced as previously described in U.S. Pat. No. 7,230,090 and U.S. Pat. No. 7,244,563 (the contents of which are hereby incorporated by reference), respectively.

cDNAs clones encoding *Calendula officinalis* and *Momordica charantia* membrane bound o-acyltransferase (MBOAT) homologs were identified by conducting BLAST (Basic Local Alignment Search Tool; Altschul et al., *J. Mol. Biol.* 215:403-410 (1993)) searches for similarity to sequences contained in the BLAST "nr" database (comprising all non-redundant GenBank CDS translations, sequences derived from the 3-dimensional structure Brookhaven Protein Data Bank, the last major release of the SWISS-PROT protein sequence database, EMBL and DDBJ databases). All cDNA sequences from either library were analyzed for similarity to all publicly available DNA sequences contained in the "nr" database using the BLASTN algorithm provided by the National Center for Biotechnology Information (NCBI). The DNA sequences were translated in all reading frames and compared for similarity to all publicly available protein sequences contained in the "nr" database using the BLASTX algorithm (Gish and States, *Nat. Genet.* 3:266-272 (1993)) provided by the NCBI. For convenience, the P-value (probability) of observing a match of a cDNA sequence to a sequence contained in the searched databases merely by chance as calculated by BLAST are reported herein as "pLog" values, which represent the negative of the logarithm of the reported P-value. Accordingly, the greater the pLog value, the greater the likelihood that the cDNA sequence and the BLAST "hit" represent homologous proteins.

*Calendula officinalis* Sequence

The BLASTX search using the nucleotide sequence from *Calendula officinalis* cDNA clone ecs1c.pk007.c17 revealed similarity of the protein encoded by the cDNA to an o-acyl-transferase (membrane bound) domain containing protein from *Ricinus communis* (Accession No. EEF51096 (GI: 223549608)). The sequence of the entire *Calendual officinalis* cDNA insert in clone ecs1c.pk007.c17 was determined, and the full cDNA sequence is shown in SEQ ID NO:1. Sequence for the coding sequence (CDS) is shown in SEQ ID NO:2. Sequence for the corresponding deduced amino acid sequence is shown in SEQ ID NO:3.

The full amino acid sequence of the protein coded for by ecs1c.pk007.c17 (SEQ ID NO:3) was evaluated by BLASTP for similarity to all publicly available protein sequences contained in the "nr" database and yielded an E value of 0 (361/463 identical amino acids) versus the hypothetical protein (MBOAT family) from *Vitis vinifera* (NCBI Accession No. XP_002282807 (GI:225426775); SEQ ID NO:4) and yielded an E value of 0 (344/463 identical amino acids) versus the membrane bound O-acyl transferase (MBOAT) family protein from *Arabidopsis thaliana* (NCBI Accession No. NP_172724 (GI:22329514); SEQ ID NO:5). BLAST scores and probabilities indicate that the instant nucleic acid fragment (SEQ ID NO:2) encodes an entire membrane o-acyl-transferase gene, hereby named CoMBOAT.

The amino acid sequence of CoMBOAT (SEQ ID NO:3) is 75.5% identical to that of *Vitis vinifera* (SEQ ID NO:4) using the Clustal V method. Sequence percent identity calculations performed by the Clustal V method (Higgins, D. G. and Sharp, P. M., *Comput. Appl. Biosci.* 5:151-153 (1989); Higgins et al., *Comput. Appl. Biosci.* 8:189-191 (1992)) were done using the MegAlign™ v6.1 program of the LASERGENE bioinformatics computing suite (supra) with the default parameters for pairwise alignment (KTUPLE=1, GAP PENALTY=3, WINDOW=5 and DIAGONALS SAVED=5 and GAP LENGTH PENALTY=10).

*Momordica charantia* Sequence

The BLASTX search using the nucleotide sequence from *Momordica charantia* cDNA clone fds1n.pk001.k4 revealed similarity of the protein encoded by the cDNA to the hypothetical protein (MBOAT family) from *Vitis vinifera* (SEQ ID NO:4) The sequence of the entire *Momordica charantia* cDNA clone fds1n.pk001.k4 was determined, and the full cDNA sequence is shown in SEQ ID NO:6. Analysis of the entire cDNA sequence from *Momordica charantia* cDNA clone fds1n.pk001.k4 (SEQ ID NO:6) by BlastX against the "nr" database suggested that the cDNA insert was lacking sequence at the 5' end and was not full length.

In order to obtain sequence for the 5' end of the gene found in fds1n.pk001.k4 (SEQ ID NO:6), 5' RACE was carried out. Total RNA was isolated from developing *Momordica charantia* seeds using the trizol reagent (Invitrogen, Carlsbad, Calif.), according to the manufacturer's protocol. Approximately 5 µg of resulting total RNA was combined with oligonucleotide oligodT and first strand cDNA was synthesized using the 5' RACE System for Rapid Amplification of cDNA Ends, Version 2.0 (Cat. No. 18374-058, Invitrogen Corporation, Carlsbad, Calif.) following the manufacturer's protocol. Subsequent PCR amplification from the cDNA using Taq polymerase (Invitrogen Corporation) following the manufacturer's protocol and using McLPCAT 5Race (SEQ ID NO:7) and the 5' RACE Abridged Anchor Primer provided in the 5' RACE kit, followed by a second round of PCR using McLPCATnew1 (SEQ ID NO:8) and the Abridged Universal Amplification Primer provided in the 5' RACE kit resulted in a PCR product which was cloned and sequenced. The resulting 5' RACE sequence obtained is set forth in SEQ ID NO:9.

Combining the 5' RACE sequence (SEQ ID NO:9) with that from cDNA clone fds1n.pk001.1(4 (SEQ ID NO:6) yields a full cDNA sequence which is set forth in SEQ ID NO:10. Sequence for the coding sequence (CDS) is shown in SEQ ID NO:11. Sequence for the corresponding deduced amino acid sequence is shown in SEQ ID NO:12.

The full amino acid sequence of *Momordica charantia* MBOAT homolog (SEQ ID NO:12) was evaluated by BLASTP for similarity to all publicly available protein sequences contained in the "nr" database and yielded an E value of 0 (366/465 identical amino acids) versus the hypothetical protein (MBOAT family) from *Vitis vinifera* (SEQ ID NO:4) and yielded an E value of 0 (3491463 identical amino adds) versus the membrane bound O-acyl transferase (MBOAT) family protein from *Arabidopsis thaliana* (SEQ ID NO:5). BLAST scores and probabilities indicate that the instant nucleic acid fragment (SEQ ID NO:11) encodes an entire membrane o-acyltransferase gene, hereby named McMBOAT.

The amino acid sequence of McMBOAT (SEQ ID NO:12) is 80.6% identical to that of *Vitis vinifera* (SEQ ID NO:4) using the Clustal V method using the default settings described above. Additionally, the amino acid sequence on McMBOAT (SEQ ID NO:12) is 74.5% identical to that of CoMBOAT (SEQ ID NO:3) when compared using Clustal V as described in Example 1.

Example 2

Identification of Diacylglycerol Acyltransferase (DGAT2) Homologs from *Calendula officinalis* and *Momordica charantia* and cDNA Libraries cDNA libraries representing mRNAs from developing seeds of *Calendula officinalis* and *Momordica charantia* were prepared and insert cDNA fragments were sequenced as described in U.S. Pat. No. 7,230,090 and U.S. Pat. No. 7,244,563, respectively.

cDNAs clones encoding *Calendula officinalis* and *Momordica charantia* diacylglycerol acyltransferase type 2 (DGAT2) homologs were identified by conducting BLAST searches for similarity to sequences contained in the BLAST "nr" database as described in Example 1.

*Calendula officinalis* Sequence

The BLASTX search using the nucleotide sequence from *Calendula officinalis cDNA clone ecs*1c.pk002.d16 revealed similarity of the protein encoded by the cDNA to a type 2 acyl-CoA diacylglycerol acyltransferase from *Ricinus communis* (NCBI Accession No. AB183668 (GI:114848908)). The sequence of the entire *Calendula officinalis* cDNA insert in clone ecs1c.pk002.d16 was determined and the full cDNA sequence is shown in SEQ ID NO:13. Sequence for the coding sequence (CDS) is shown in SEQ ID NO:14. Sequence for the corresponding deduced amino acid sequence is shown in SEQ ID NO:15.

The full amino acid sequence of the protein coded for by ecs1c.pk002.d16 (SEQ ID NO:15) was evaluated by BLASTP for similarity to all publicly available protein sequences contained in the "nr" database and yielded an E value of 5.3e-96 (178/302 identical amino acids) versus the hypothetical protein from *Vitis vinifera* (NCBI Accession No. XP_002263626 (GI:225431649); SEQ ID NO:16) and yielded an E value of 1.3e-92 (172/302 identical amino acids) versus the diacylglycerol acyltransferase from *Elaeis oleifera* (NCBI Accession No. ACO35365 (GI:225904451); SEQ ID NO:17). BLAST scores and probabilities indicate that the instant nucleic acid fragment (SEQ ID NO:14) encodes an entire DGAT2 gene, hereby named CoDGAT2.

The amino acid sequence of CoDGAT2 (SEQ ID NO:15) is 53.9% identical to that of *Vitis vinifera* (SEQ ID NO:16) using the Clustal V method. Sequence percent identity calculations performed by the Clustal V method were as described in Example 1.

*Momordica charantia* Sequence

The BLASTX search using the nucleotide sequence from *Momordica charantia* cDNA clone fds.pk0003.g7 revealed similarity of the protein encoded by the cDNA to a putative type-2 acyl-CoA:diacylglycerol acyltransferase b from *Brassica napus* (NCBI Accession No. AC090188 (GI: 226897458)). The sequence of the entire *Momordica charantia* cDNA clone fds.pk0003.g7 was determined and the full cDNA sequence is shown in SEQ ID NO:18. Analysis of the entire cDNA sequence from *Momordica charantia* cDNA clone fds.pk0003.g7 (SEQ ID NO:18) by BlastX against the "nr" database suggested that the cDNA contained an unspliced intron at the 5' end.

In order to obtain a correct sequence for the 5' end for the *Momordica charantia* DGAT2 homolog gene, 5' RACE was carried out. First strand cDNA synthesized as described in Example 1 was amplified with Taq polymerase (Invitrogen Corporation) following the manufacturer's protocol and using oligonucleotide McDGAT2 Race1 (SEQ ID NO:19) and the 5' RACE Abridged Anchor Primer from the 5' RACE kit. This resulted in a PCR product which was cloned and sequenced. The resulting 5' RACE sequence obtained is set forth in SEQ ID NO:20 and confirmed an unspliced intron had been present in clone fds.pk0003.g7 (SEQ ID NO:18). But, when the 5' RACE sequence (SEQ ID NO:20) was combined with the sequence from clone fds.pk0003.g7 (SEQ ID NO:18) and evaluated by BlastX against the "nr" database, the results suggested that the sequence still contained another unspliced intron at the 5' end but downstream (i.e. in the 3' direction) of oligonucleotide McDGAT2 Race1 (SEQ ID NO:19). In order to evaluate this and obtain the correct cDNA sequence, oligonucleotides McDGAT2 Not5 (SEQ ID NO:21) and McDGAT2 Not3 (SEQ ID NO:22) were used to amplify the putative full length coding sequence from the first strand cDNA using Taq polymerase (Invitrogen Corporation) and following the manufacturer's protocol. The sequence from the resulting PCR product and containing NotI sites flanking the *Momordica charantia* gene is set forth in SEQ ID NO:23 again showed that fds.pk0003.g7 contained a second unspliced intron. A full, corrected cDNA sequence for the *Momordica* DGAT2 homolog is set forth in SEQ ID NO:24. Sequence for the coding sequence (CDS) is shown in SEQ ID NO:25. Sequence for the corresponding deduced amino acid sequence is shown in SEQ ID NO:26.

The full amino acid sequence of the *Momordica charantia* DGAT2 homolog (SEQ ID NO:26) was evaluated by BLASTP for similarity to all publicly available protein sequences contained in the "nr" database and yielded an E value of e-128 (223/318 identical amino acids) versus the hypothetical protein from *Vitis vinifera* (SEQ ID NO:16) and yielded an E value of e-118 (201/299 identical amino acids) versus the diacylglycerol acyltransferase from *Arabidopsis thaliana* (NCBI Accession No. NP_566952 (GI:18409359); SEQ ID NO:27). BLAST scores and probabilities indicate that the instant nucleic acid fragment (SEQ ID NO:25) encodes an entire DGAT2 gene, hereby named McDGAT2.

The amino acid sequence of McDGAT2 (SEQ ID NO:26) is 68.5% identical to that of *Vitis vinifera* (SEQ ID NO:16) using the Clustal V method using the default settings described in Example 1. Additionally, the amino acid sequence on McDGAT2 (SEQ ID NO:26) is 51.1% identical to that of CoDGAT2 (SEQ ID NO:15) when compared using Clustal V as described in Example 1.

Example 3

Construction of Soybean Expression Vectors for Co-Expressing *Momordica charantia* Conjugase (McConj) with McDGAT2 and/or McMBOAT McDGAT2 (SEQ ID NO:25) was PCR amplified from the first strand cDNA as described in Example 2 and the resulting PCR product, flanked by NotI sites, was cloned into the pGEM®-T Easy Vector (Promega) following the manufacturer's protocol to produce pHD40 (SEQ ID NO:28). The NotI fragment of pHD40, containing McDGAT2, was cloned into the NotI site of pKR974, which was previously described in PCT Publication No. WO 2008/137516 (the contents of which is incorporated by reference), to produce pKR1543 (SEQ ID NO:29). In pKR1543, McDGAT2 is under control of the soy glycinin Gy1 promoter.

Cloning of the *Momordica charantia* fatty acid conjugase (McConj; SEQ ID NO:30) flanked by NotI sites into soybean expression vector KS67 was described previously in U.S. Pat. No. 7,244,563, and the expression vector described there is hereby named pKmo-1. The NotI fragment of pKmo-1, containing McConj, was cloned into the NotI site of pKR72, which was previously described in PCT Publication No. WO 2004/071467 (the contents of which is incorporated by reference), to produce pKR458 (SEQ ID NO:31). In pKR458, McConj is under control of the soy beta-conglycinin promoter.

McMBOAT was PCR amplified from the first strand cDNA described in Example 1 using Tag polymerase (Invitrogen Corporation) following the manufacturer's protocol with oligonucleotide McLPCATNot5 (SEQ ID NO:32) and McLPCATNot3 (SEQ ID NO:33). The resulting PCR product was cloned into the pGEM®-T Easy Vector (Promega) following the manufacturer's protocol to produce pHD41 (SEQ ID NO:34). The NotI fragment of pHD41 (SEQ ID NO:34), containing McMBOAT, was cloned into the NotI site of pKR457, which was previously described in U.S. Pat. No. 7,256,033 (the contents of which is incorporated by reference). The resulting intermediate vector containing McMBOAT under control of the soy KTi promoter was digested with BsiWI and the fragment containing McMBOAT was cloned into the BsiWI site of pKR458 (SEQ ID NO:31) to produce pKR1548 (SEQ ID NO:35). In pKR1548, McConj is under control of the soy beta-conglycinin promoter and McMBOAT is under control of the KTi promoter.

The SbfI fragment of pKR1543 (SEQ ID NO:29), containing McDGAT2, was cloned into the SbfI site of pKR1548 (SEQ ID NO:35) to produce pKR1556 (SEQ ID NO:36). In pKR1556, McConj is under control of the soy beta-conglycinin promoter, McMBOAT is under control of the KTi promoter and McDGAT2 is under control of the soy glycinin Gy1 promoter.

Plasmid pKR1556 (SEQ ID NO:36) was digested with BsiWI and the fragment containing McConj and McDGAT2 was religated to produce pKR1562 (SEQ ID NO:37). In pKR1562, McConj is under control of the soy beta-conglycinin promoter, and McDGAT2 is under control of the soy glycinin Gy1 promoter.

Example 4

Construction of Soybean Expression Vectors for Co-Expressing *Calendula officinalis* Conjugase (CoConj) with CoDGAT2 and/or CoMBOAT CoDGAT2 (SEQ ID NO:14) was PCR amplified from clone ecs1c.pk002.d16, described in Example 2, using the Phusion™ High-Fidelity DNA Polymerase (Cat. No. F553S, Finnzymes Oy, Finland) following the manufacturer's protocol and using oligonucleotide CoDGAT-5Not (SEQ ID NO:38) and CoDGAT-3Not (SEQ ID NO:39). The resulting DNA fragment was cloned into the pCR-Blunt® cloning vector using the Zero Blunt® PCR Cloning Kit (Invitrogen Corporation), following the manufacturer's protocol, to produce pLF167 (SEQ ID NO:76). The NotI fragment of pLF167 (SEQ ID NO:76), containing CoDGAT2, was cloned into the NotI site of pKR407, previously described in PCT Publication No. WO 2008/124048 (the contents of which is incorporated by reference), to produce pKR1493 (SEQ ID NO:40). In pKR1493, CoDGAT2 is under control of the soy glycinin Gy1 promoter.

Cloning of the *Calendula officinalis* fatty acid conjugase (CoConj; SEQ ID NO:41) flanked by NotI sites into a yeast expression vector was described previously in U.S. Pat. No. 7,230,090, and the expression vector described there is hereby named pY32. The NotI fragment of pY32, containing McConj, was cloned into the NotI site of pKR72, which was previously described in PCT Publication No. WO 2004/071467, to produce pKR1487 (SEQ ID NO:42). In pKR1487, CoConj is under control of the soy beta-conglycinin promoter.

The 5' end of CoMBOAT (SEQ ID NO:2) was PCR amplified from clone ecs1c.pk007.c17, described in Example 1, using the Phusion™ High-Fidelity DNA Polymerase (Cat. No. F553S, Finnzymes Oy, Finland) following the manufacturer's protocol and using oligonucleotide CoLPCAT-5Not (SEQ ID NO:43) and CoLPCATNco-3 (SEQ ID NO:44), which was designed to delete an internal NcoI site but not alter the amino acid sequence. The 3' end of CoMBOAT (SEQ ID NO:2) was PCR amplified from clone ecs1c.pk007.c17 similarly but using oligonucleotide CoLPCATNco-5 (SEQ ID NO:45), which was designed to delete an internal NcoI site, but not alter the amino acid sequence, and CoLPCAT-3Not (SEQ ID NO:46). The resulting PCR products were purified, combined and re-amplified using CoLPCAT-5Not (SEQ ID NO:43) and CoLPCAT-3Not (SEQ ID NO:46). The new DNA sequence of CoMBOAT which has the NotI site removed but does not change the encoded amino acid sequence is set forth in SEQ ID NO:47. The resulting DNA fragment was cloned into the pCR-Blunt® cloning vector using the Zero Blunt® PCR Cloning Kit (Invitrogen Corporation), following the manufacturer's protocol, to produce pLF166 (SEQ ID NO:48). The NotI fragment of pLF166 (SEQ ID NO:48), containing CoMBOAT, was cloned into the NotI site of pKR457, which was previously described in U.S. Pat. No. 7,256,033. The resulting intermediate vector containing CoMBOAT under control of the soy KTi promoter was digested with BsiWI and the fragment containing CoMBOAT was cloned into the BsiWI site of pKR1487 (SEQ ID NO:42) to produce pKR1492 (SEQ ID NO:49). In pKR1492, CoConj is under control of the soy beta-conglycinin promoter, and CoMBOAT is under control of the KTi promoter.

The PstI fragment of pKR1493 (SEQ ID NO:40), containing CoDGAT2 was cloned into the SbfI site of pKR1492 (SEQ ID NO:49) to produce pKR1498 (SEQ ID NO:50). In pKR1498, CoConj is under control of the soy beta-conglycinin promoter, CoMBOAT is under control of the KTi promoter, and CoDGAT2 is under control of the soy glycinin Gy1 promoter.

Plasmid pKR1498 (SEQ ID NO:50) was digested with BsiWI and the fragment containing CoConj and CoDGAT2 was religated to produce pKR1504 (SEQ ID NO:51). In pKR1504, CoConj is under control of the soy beta-conglycinin promoter, and CoDGAT2 is under control of the soy glycinin Gy1 promoter.

Example 5

Construction of *Arabidopsis* Expression Vectors for Co-Expressing McConj with McDGAT2 and/or McMBOAT and for Co-expressing CoConj with CoDGAT2 and/or CoMBOAT An *Arabidopsis* binary vector (pKR92) containing a unique AscI site for cloning expression cassettes was previously described in WO 2007/061845 (the contents of which are incorporated by reference).

The AscI fragment of pKR458 (SEQ ID NO:31), containing McConj, was cloned into the AscI site of pKR92 to produce pKR539 (SEQ ID NO:52).

The AscI fragment of pKR1548 (SEQ ID NO:35), containing McConj and McMBOAT, was cloned into the AscI site of pKR92 to produce pKR1563 (SEQ ID NO:53).

The AscI fragment of pKR1556 (SEQ ID NO:36), containing McConj, McMBOAT and McDGAT2, was cloned into the AscI site of pKR92 to produce pKR1564 (SEQ ID NO:54).

The AscI fragment of pKR1562 (SEQ ID NO:37), containing McConj and McDGAT2, was cloned into the AscI site of pKR92 to produce pKR1565 (SEQ ID NO:55).

The AscI fragment of pKR1487 (SEQ ID NO:42), containing CoConj, was cloned into the AscI site of pKR92 to produce pKR1507 (SEQ ID NO:56).

The AscI fragment of pKR1492 (SEQ ID NO:49), containing CoConj and CoMBOAT, was cloned into the AscI site of pKR92 to produce pKR1508 (SEQ ID NO:57).

The AscI fragment of pKR1498 (SEQ ID NO:50), containing CoConj, CoMBOAT and CoDGAT2, was cloned into the AscI site of pKR92 to produce pKR1509 (SEQ ID NO:58).

The AscI fragment of pKR1504 (SEQ ID NO:51), containing CoConj and CoDGAT2, was cloned into the AscI site of pKR92 to produce pKR1510 (SEQ ID NO:59).

Example 6

Construction of Soybean Expression Vectors for Co-Expressing *Mortierella* alpine Delta-6 Desaturase (MaD6Des) and *Mortierella alpina* Elongase (MaElo) with Either CoMBOAT or McMBOAT The construction of plasmids pKR272 (SEQ ID NO:106) was previously described in U.S. Pat. No. 7,256,033 and consisted of releasing the Gy1/Maelo/legA2 cassette from plasmid pKR270 by digestion with BsiWI and SbfI and was cloned into the BsiWI/SbfI sites of plasmid pKR269 (containing the delta-6 desaturase, the T7prom/hpt/T7term cassette and the bacterial ori region). This was designated as plasmid pKR272 (SEQ ID NO:106). Plasmid pKR278 was constructed as described below. A starting plasmid pKR85, containing the hygromycin B phosphotransferase gene (HPT) (Gritz, L. and Davies, J., Gene 25:179-188 (1983)), flanked by the T7 promoter and transcription terminator (T7prom/hpt/T7term cassette), and a bacterial origin of replication (ori) for selection and replication in bacteria (e.g., *E. coli*) was used. In addition, pKR72 also contains the hygromycin B phosphotransferase gene, flanked by the 35S promoter (Odell et al., *Nature* 313:810-812 (1985)) and NOS 3' transcription terminator (Depicker et al., *J. Mol. Appl. Genet.* 1:561-570 (1982)) (35S/hpt/NOS3' cassette) for selection in plants such as soybean. Plasmid pKR85 also contains a NotI restriction site, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)), called Bcon/NotI/Phas3' cassette.

The Bcon/NotI/Phas3' cassette was removed from pKR85 by digestion with HindIII and the resulting fragment was re-ligated to produce pKR278 (SEQ ID NO:107).

The AscI fragment of pKR272, containing the *Mortierella alpina* delta-6 desaturase (MaD6Des) and the *Mortierella alpine* elongase (MaElo), was cloned into the AscI site of pKR278 to produce pKR1561 (SEQ ID NO:60). In pKR1561, MaD6Des is under control of the soy beta-conglycinin promoter and MaElo is under control of the soy glycinin Gy1 promoter.

The intermediate vector, containing McMBOAT under control of the soy KTi promoter described in Example 3, was digested with BsiWI and the fragment containing McMBOAT was cloned into the BsiWI site of pKR272 to produce pKR1544 (SEQ ID NO:61). The AscI fragment of pKR1544 (SEQ ID NO:61), containing MaD6Des, MaElo and McMBOAT, was cloned into the AscI site of pKR278 to produce pKR1549 (SEQ ID NO:62). In pKR1549, MaD6Des is under control of the soy beta-conglycinin promoter, MaElo is under control of the soy glycinin Gy1 promoter and McMBOAT is under control of the soy KTi promoter.

The intermediate vector, containing CoMBOAT under control of the soy KTi promoter described in Example 4, was digested with BsiWI and the fragment containing CoMBOAT was cloned into the BsiWI site of pKR272 to produce pKR1546 (SEQ ID NO:63). The AscI fragment of pKR1546 (SEQ ID NO:63), containing MaD6Des, MaElo and CoMBOAT, was cloned into the AscI site of pKR278 to produce pKR1557 (SEQ ID NO:64). In pKR1557, MaD6Des is under control of the soy beta-conglycinin promoter, MaElo is under control of the soy glycinin Gy1 promoter and CoMBOAT is under control of the soy KTi promoter.

Example 7

Construction of Soybean Expression Vectors for Co-Expressing *Euglena gracilis* Delta-9 Elongase (EgD9Elo) and *Tetruetreptia pomquetensis* Delta-8 Desaturase (TpomD8Des) with Either CoMBOAT or McMBOAT The construction of plasmid pKR1020r was previously described in PCT Publication No. WO 2008/063340, the contents of which are incorporated by reference. The AscI fragment of pKR1020r, containing the *Euglena gracilis* delta-9 elongase (EgD9Elo) and the *Tetruetreptia pomquetensis* delta-8 desaturase (TpomD8Des), was cloned into the AscI site of pKR278 to produce pKR1560 (SEQ ID NO:65). In pKR1560, EgD9Elo is under control of the soy beta-conglycinin promoter, and TpomD8Des is under control of the soy glycinin Gy1 promoter.

The intermediate vector, containing McMBOAT under control of the soy KTi promoter described in Example 3, was digested with BsiWI and the fragment containing McMBOAT was cloned into the BsiWI site of pKR1020r to produce pKR1545 (SEQ ID NO:66). The AscI fragment of pKR1545 (SEQ ID NO:66), containing EgD9Elo, TpomD8Des and McMBOAT, was cloned into the AscI site of pKR278 to produce pKR1550 (SEQ ID NO:67). In pKR1550, EgD9Elo is under control of the soy beta-conglycinin promoter, TpomD8Des is under control of the soy glycinin Gy1 promoter and McMBOAT is under control of the soy KTi promoter.

The intermediate vector, containing CoMBOAT under control of the soy KTi promoter described in Example 4, was digested with BsiWI and the fragment containing CoMBOAT was cloned into the BsiWI site of pKR1020R to produce pKR1547 (SEQ ID NO:68). The AscI fragment of pKR1547 (SEQ ID NO:68), containing EgD9Elo, TpomD8Des and CoMBOAT, was cloned into the AscI site of pKR278 to produce pKR1558 (SEQ ID NO:69). In pKR1558, EgD9Elo is under control of the soy beta-conglycinin promoter, TpomD8Des is under control of the soy glycinin Gy1 promoter and CoMBOAT is under control of the soy KTi promoter.

Example 8

Construction of *Arabidopsis* Expression Vectors for Co-Expressing MaD6Des and MaElo with McMBOAT or CoMBOAT and for Co-Expressing EgD9Elo and TpomD8Des with McMBOAT or CoMBOAT The AscI fragment of pKR272, containing MaD6Des and MaElo, was cloned into the AscI site of pKR92 to produce pKR1559 (SEQ ID NO:70).

The AscI fragment of pKR1544 (SEQ ID NO:61), containing MaD6Des, MaElo and McMBOAT, was cloned into the AscI site of pKR92 to produce pKR1552 (SEQ ID NO:71).

The AscI fragment of pKR1546 (SEQ ID NO:63), containing MaD6Des, MaElo and CoMBOAT, was cloned into the AscI site pKR92 to produce pKR1554 (SEQ ID NO:72).

The AscI fragment of pKR1020r, containing EgD9Elo and TpomD8Des, was cloned into the AscI site of pKR92 to produce pKR1022 (SEQ ID NO:73).

The AscI fragment of pKR1545 (SEQ ID NO:66), containing EgD9Elo, TpomD8Des and McMBOAT, was cloned into the AscI site of pKR92 to produce pKR1553 (SEQ ID NO:74).

The AscI fragment of pKR1547 (SEQ ID NO:68), containing EgD9Elo, TpomD8Des and CoMBOAT, was cloned into the AscI site of pKR92 to produce pKR1555 (SEQ ID NO:75).

Example 9

Co-Expressing MaD6Des and MaElo (Delta-6 Desaturase Pathway) with McMBOAT or CoMBOAT in *Arabidopsis* Seed Generation and Analysis of Transgenic *Arabidopsis* Lines:

Plasmid DNA of pKR1559 (SEQ ID NO:70), comprising MaD6Des and MaElo, pKR1552 (SEQ ID NO:71), comprising MaD6Des, MaElo and McMBOAT, or pKR1554 (SEQ ID NO:72), comprising MaD6Des, MaElo and CoMBOAT, was introduced into *Agrobacterium tumefaciens* NTL4 (Luo et al, *Molecular Plant-Microbe Interactions* 14(1):98-103 (2001)) by electroporation. Briefly, 1 µg plasmid DNA was mixed with 100 µL of electro-competent cells on ice. The cell suspension was transferred to a 100 µL electro oration curette (1 mm gap width) and electroporated using a BIORAD electro orator set to 1 kV, 400Ω and 25 µF. Cells were transferred to 1 mL LB medium and incubated for 2 h at 30° C. Cells were plated onto LB medium containing 50 µg/mL kanamycin. Plates were incubated at 30° C. for 60 h. Recombinant *agrobacterium* cultures (500 mL LB, 50 µg/mL kanamycin) were inoculated from single colonies of transformed *agrobacterium* cells and grown at 30° C. for 60 h. Cells were harvested by centrifugation (5000×g, 10 min) and resuspended in 1 L of 5% (W/N) sucrose containing 0.05% (V/V) Silwet.

*Arabidopsis* plants were grown in soil at a density of 30 plants per 100 cm² pot in metromix 360 soil mixture for 4 weeks (22° C., permanent light, 100 µE m$^{-2}$s$^{-1}$). Plants were repeatedly dipped into the *agrobacterium* suspension harboring the binary vectors and kept in a dark, high humidity environment for 24 h. Plants were grown for four to five weeks under standard plant growth conditions described above, and plant material was harvested and dried for one week at ambient temperatures in paper bags. Seeds were harvested using a 0.425 mm mesh brass sieve.

Cleaned *Arabidopsis* seeds (2 g, corresponding to about 100,000 seeds) were sterilized by washes in 45 mL of 80% ethanol, 0.01% triton X-100, followed by 45 mL of 30% (V/V) household bleach in water, 0.01% triton X-100 and finally by repeated rinsing in sterile water. Aliquots of 20,000 seeds were transferred to square plates (20×20 cm) containing 150 mL of sterile plant growth medium comprised of 0.5×MS salts, 1.0% (W/N) sucrose, 0.05 MES/KOH (pH 5.8), 200 µg/mL timentin, and 50 µg/mL kanamycin solidified with 10 g/L agar. Homogeneous dispersion of the seed on the medium was facilitated by mixing the aqueous seed suspension with an equal volume of melted plant growth medium, Plates were incubated under standard growth conditions for ten days.

Kanamycin-resistant seedlings were transferred to soil (Metromix 360) and grown to maturity for 8-10 weeks as described above. For each construct, approximately 24 individual kanamycin resistant seedlings (events) were planted and plants were grown in flats with 36 inserts. T2 seeds were harvested from individual plants and the fatty acid composition of the seed oil was determined as follows.

Analysis of the Fatty Acid Profile of *Arabdidopsis* Seed

Bulk T2 seed lipid fatty acid profiles for each event were obtained by transesterification with TMSH to form fatty acid methyl esters (FAME). For each event, a small scoopful of seeds (approximately 25-50 seed each scoopful) was crushed in 50 µL of TMSH in a 1.5 mL eppendorf tube. After shaking in TMSH for 15 min, 400 µL of heptane was added and the tubes were vortexed well, shaken for an additional 15 min and centrifuged at 13,000×g for 1 min. After shaking, the heptane layer was removed into glass GC vials and the fatty acid methyl esters were analyzed as follows.

Fatty acid methyl esters (1 µL injected from hexane layer) were separated and quantified using a Hewlett-Packard 6890 Gas Chromatograph fitted with an Omegawax 320 fused silica capillary column (Catalog #24152, Supelco Inc.). The oven temperature was programmed to hold at 220° C. for 2.6 min, increase to 240° C. at 20° C./min and then hold for an additional 2.4 min. Carrier gas was supplied by a Whatman hydrogen generator. Retention times were compared to those for methyl esters of standards commercially available (Nu-Chek Prep, Inc.). Results for fatty acid analysis of T2 bulk seed pools for events from *Arabidopsis* transformed with pKR1559 (SEQ ID NO:70), comprising MaD6Des and MaElo, pKR1552 (SEQ ID NO:71), comprising MaD6Des, MaElo and McMBOAT, or pKR1554 (SEQ ID NO:72), comprising MaD6Des, MaElo and CoMBOAT are summarized in TABLEs 2, 3, and 4, respectively. A typical fatty acid profile for wild-type *Arabidopsis* seed is also shown in TABLE 2.

In the Tables, the fatty acid profiles as a weight percent of total fatty acids are shown where 16:0 is palmitic acid, 18:0 is stearic acid, 18:1 is oleic acid, 18:2 is linoleic acid, GLA is gamma-linolenic acid, 18:3 is alpha-linolenic acid, STA is stearidonic acid, 20:1 is eicosenoic acid [20:1(Δ11)], EDA is eicosadienoic acid [20:2(Δ11,14)], DGLA is dihomo-gamma-linolenic acid, ERA is eicosatrienoic acid [20:3(Δ11,14,17)] and ETA is eicosatetraenoic acid [20:1(Δ8,11,14,17)]. The sum of GLA+STA, EDA+ERA or DGLA+ETA is also shown. Results for each event are sorted according to DGLA+ETA concentrations in decreasing order. The average fatty acid profiles for the five events having highest DGLA+ETA content from each experiment are also shown in each table (Avg. **).

TABLE 2

Fatty Acid Analysis of T2 bulk seed pools for events from *Arabidopsis* transformed with pKR1559 comprising MaD6Des and MaElo

| Event # | 16:0 | 18:0 | 18:1 | 18:2 | GLA | 18:3 | STA | 20:1 | EDA | DGLA | ERA | ETA | GLA + STA | EDA + ERA | DGLA + ETA |
|---|---|---|---|---|---|---|---|---|---|---|---|---|---|---|---|
| 17 | 9.1 | 3.0 | 11.1 | 21.8 | 8.1 | 16.7 | 2.8 | 17.5 | 3.1 | 5.2 | 0.0 | 1.6 | 10.9 | 3.1 | 6.8 |
| 16 | 9.3 | 2.8 | 10.8 | 22.5 | 8.2 | 18.4 | 2.8 | 15.6 | 3.0 | 5.1 | 0.0 | 1.5 | 11.1 | 3.0 | 6.6 |
| 23 | 8.4 | 2.6 | 12.0 | 23.9 | 7.2 | 17.5 | 2.2 | 17.3 | 3.0 | 4.6 | 0.0 | 1.2 | 9.4 | 3.0 | 5.8 |
| 15 | 8.3 | 2.8 | 12.5 | 24.4 | 6.8 | 17.6 | 1.9 | 17.9 | 2.9 | 3.9 | 0.0 | 0.9 | 8.7 | 2.9 | 4.8 |
| 22 | 8.2 | 2.7 | 12.9 | 24.4 | 7.5 | 17.1 | 2.1 | 17.8 | 2.8 | 3.7 | 0.0 | 0.9 | 9.6 | 2.8 | 4.6 |
| 14 | 8.6 | 3.0 | 11.7 | 22.3 | 7.6 | 18.1 | 2.6 | 18.8 | 2.8 | 3.4 | 0.0 | 1.1 | 10.2 | 2.8 | 4.5 |
| 11 | 8.3 | 3.1 | 12.5 | 21.4 | 9.0 | 16.7 | 2.9 | 19.4 | 2.6 | 3.3 | 0.0 | 0.9 | 11.9 | 2.6 | 4.1 |
| 13 | 8.7 | 13.2 | 0.0 | 25.3 | 6.8 | 18.5 | 2.1 | 18.5 | 2.7 | 3.2 | 0.0 | 0.9 | 9.0 | 2.7 | 4.1 |
| 18 | 7.9 | 2.9 | 14.3 | 24.1 | 6.6 | 16.5 | 1.9 | 19.3 | 2.6 | 3.1 | 0.0 | 0.8 | 8.5 | 2.6 | 3.9 |
| 6 | 7.8 | 3.0 | 14.5 | 23.5 | 7.3 | 16.4 | 2.0 | 18.0 | 2.6 | 3.0 | 1.1 | 0.7 | 9.3 | 3.7 | 3.7 |
| 2 | 7.4 | 2.9 | 15.2 | 25.7 | 5.7 | 16.4 | 1.4 | 18.9 | 2.5 | 2.4 | 0.9 | 0.5 | 7.1 | 3.4 | 2.9 |

TABLE 2-continued

Fatty Acid Analysis of T2 bulk seed pools for events from *Arabidopsis* transformed with pKR1559 comprising MaD6Des and MaElo

| Event # | 16:0 | 18:0 | 18:1 | 18:2 | GLA | 18:3 | STA | 20:1 | EDA | DGLA | ERA | ETA | GLA + STA | EDA + ERA | DGLA + ETA |
|---|---|---|---|---|---|---|---|---|---|---|---|---|---|---|---|
| 3 | 7.5 | 2.8 | 15.3 | 26.7 | 4.2 | 17.4 | 1.1 | 19.0 | 2.7 | 1.8 | 1.0 | 0.5 | 5.3 | 3.6 | 2.3 |
| 1 | 8.2 | 2.8 | 15.3 | 29.2 | 2.5 | 19.0 | 0.6 | 18.6 | 2.0 | 1.1 | 0.5 | 0.3 | 3.1 | 2.5 | 1.4 |
| 20 | 8.4 | 2.6 | 14.9 | 31.3 | 1.2 | 19.2 | 0.3 | 19.4 | 2.3 | 0.4 | 0.0 | 0.0 | 1.5 | 2.3 | 0.4 |
| 9 | 8.6 | 2.8 | 16.0 | 31.2 | 1.0 | 19.8 | 0.2 | 17.5 | 2.0 | 0.3 | 0.5 | 0.0 | 1.2 | 2.5 | 0.3 |
| 19 | 8.9 | 2.8 | 13.7 | 32.7 | 0.4 | 21.1 | 0.1 | 16.8 | 3.4 | 0.2 | 0.0 | 0.0 | 0.5 | 3.4 | 0.2 |
| 7 | 8.0 | 2.9 | 16.1 | 30.9 | 0.1 | 20.4 | 0.0 | 18.8 | 2.1 | 0.1 | 0.6 | 0.0 | 0.2 | 2.7 | 0.1 |
| 10 | 7.1 | 2.3 | 18.8 | 30.2 | 0.3 | 20.0 | 0.1 | 19.4 | 1.5 | 0.1 | 0.4 | 0.0 | 0.4 | 1.8 | 0.1 |
| 21 | 7.3 | 2.2 | 16.3 | 32.2 | 0.2 | 20.2 | 0.0 | 19.5 | 2.1 | 0.1 | 0.0 | 0.0 | 0.2 | 2.1 | 0.1 |
| 4 | 8.1 | 2.7 | 18.3 | 36.4 | 0.1 | 15.1 | 0.0 | 15.0 | 3.3 | 0.0 | 1.1 | 0.0 | 0.1 | 4.3 | 0.0 |
| 5 | 8.6 | 2.8 | 15.5 | 24.9 | 8.4 | 18.1 | 2.3 | 17.1 | 1.8 | 0.0 | 0.5 | 0.0 | 10.7 | 2.3 | 0.0 |
| 8 | 7.3 | 2.6 | 17.9 | 29.9 | 0.1 | 21.0 | 0.0 | 19.0 | 1.7 | 0.0 | 0.4 | 0.0 | 0.1 | 2.2 | 0.0 |
| 12 | 7.5 | 2.0 | 17.1 | 28.7 | 0.0 | 22.2 | 0.0 | 20.8 | 1.8 | 0.0 | 0.0 | 0.0 | 0.0 | 1.8 | 0.0 |
| Avg.** | 8.6 | 2.8 | 11.9 | 23.4 | 7.6 | 17.5 | 2.4 | 17.2 | 3.0 | 4.5 | 0.0 | 1.2 | 9.9 | 3.0 | 5.7 |

TABLE 3

Fatty Acid Analysis of T2 bulk seed pools for events from *Arabidopsis* transformed with pKR1552 comprising MaD6Des, MaElo and McMBOAT

| Event # | 16:0 | 18:0 | 18:1 | 18:2 | GLA | 18:3 | STA | 20:1 | EDA | DGLA | ERA | ETA | GLA + STA | EDA + ERA | DGLA + ETA |
|---|---|---|---|---|---|---|---|---|---|---|---|---|---|---|---|
| 9 | 10.0 | 3.8 | 9.8 | 7.6 | 19.3 | 6.4 | 5.9 | 11.3 | 3.3 | 16.3 | 2.2 | 4.1 | 25.2 | 5.5 | 20.4 |
| 17 | 8.3 | 3.0 | 11.6 | 18.9 | 9.0 | 12.3 | 2.4 | 12.9 | 3.2 | 13.0 | 1.7 | 3.4 | 11.5 | 5.0 | 16.5 |
| 11 | 9.2 | 3.3 | 18.5 | 9.9 | 11.4 | 2.6 | 12.4 | 3.2 | 12.9 | 1.6 | 3.4 | 12.4 | 4.8 | 16.3 |
| 18 | 9.2 | 3.2 | 13.4 | 12.2 | 16.5 | 9.1 | 4.7 | 10.8 | 3.0 | 12.8 | 1.9 | 3.0 | 21.2 | 4.9 | 15.8 |
| 1 | 8.4 | 3.7 | 10.3 | 12.2 | 16.4 | 9.5 | 5.0 | 13.5 | 3.1 | 12.1 | 2.2 | 3.4 | 21.4 | 5.4 | 15.5 |
| 16 | 9.0 | 3.2 | 11.3 | 18.8 | 9.9 | 13.1 | 3.0 | 13.2 | 3.2 | 10.5 | 1.7 | 3.1 | 12.9 | 4.9 | 13.6 |
| 19 | 8.6 | 3.9 | 11.5 | 13.1 | 17.2 | 9.4 | 4.5 | 13.7 | 3.1 | 10.5 | 2.0 | 2.5 | 21.7 | 5.1 | 13.0 |
| 2 | 7.5 | 3.3 | 11.7 | 15.7 | 13.8 | 12.4 | 3.9 | 16.6 | 3.1 | 8.0 | 1.9 | 2.2 | 17.7 | 5.0 | 10.2 |
| 6 | 7.6 | 3.2 | 12.2 | 16.0 | 14.4 | 13.0 | 4.2 | 15.2 | 3.0 | 7.3 | 1.9 | 1.9 | 18.6 | 5.0 | 9.2 |
| 13 | 7.9 | 3.1 | 11.9 | 21.0 | 9.4 | 15.8 | 2.5 | 16.4 | 2.7 | 6.2 | 1.3 | 1.7 | 11.9 | 4.0 | 7.9 |
| 3 | 7.8 | 3.1 | 13.1 | 23.2 | 6.4 | 16.8 | 1.6 | 16.2 | 3.0 | 5.8 | 1.6 | 1.5 | 8.0 | 4.6 | 7.3 |
| 15 | 7.7 | 3.0 | 12.9 | 24.6 | 6.3 | 15.9 | 1.5 | 16.7 | 3.1 | 5.6 | 1.4 | 1.4 | 7.8 | 4.4 | 7.0 |
| 21 | 8.1 | 3.2 | 12.2 | 22.4 | 8.2 | 16.1 | 2.1 | 17.0 | 2.8 | 5.4 | 1.3 | 1.3 | 10.3 | 4.1 | 6.7 |
| 14 | 7.9 | 2.9 | 14.3 | 24.9 | 5.6 | 16.7 | 1.4 | 17.0 | 2.7 | 4.3 | 1.2 | 1.0 | 7.0 | 3.9 | 5.3 |
| 4 | 7.5 | 3.1 | 13.6 | 24.7 | 5.5 | 17.5 | 1.4 | 17.9 | 2.8 | 3.8 | 1.3 | 0.9 | 6.9 | 4.0 | 4.7 |
| 10 | 8.9 | 2.9 | 15.7 | 28.3 | 3.7 | 16.9 | 0.9 | 14.0 | 3.3 | 3.2 | 1.4 | 0.7 | 4.6 | 4.8 | 3.9 |
| 5 | 8.6 | 2.9 | 14.7 | 28.3 | 4.2 | 17.1 | 1.1 | 14.6 | 3.3 | 3.0 | 1.4 | 0.9 | 5.3 | 4.7 | 3.8 |
| 20 | 7.7 | 3.0 | 14.9 | 31.9 | 0.7 | 18.5 | 0.1 | 17.8 | 3.5 | 0.4 | 1.4 | 0.1 | 0.8 | 4.9 | 0.5 |
| 12 | 8.1 | 2.7 | 15.7 | 32.2 | 0.2 | 20.3 | 0.1 | 18.0 | 1.8 | 0.3 | 0.4 | 0.1 | 0.3 | 2.2 | 0.4 |
| 7 | 7.6 | 2.7 | 17.1 | 33.0 | 0.3 | 18.9 | 0.1 | 17.8 | 1.9 | 0.2 | 0.5 | 0.0 | 0.3 | 2.4 | 0.2 |
| 8 | 7.9 | 3.1 | 16.0 | 26.7 | 4.6 | 19.6 | 1.4 | 18.4 | 1.8 | 0.0 | 0.5 | 0.0 | 6.0 | 2.3 | 0.0 |
| Avg.** | 9.0 | 3.4 | 11.4 | 13.9 | 14.2 | 9.8 | 4.1 | 12.2 | 3.2 | 13.4 | 1.9 | 3.5 | 18.3 | 5.1 | 16.9 |
| Col-1 | 8.0 | 2.8 | 15.7 | 31.3 | 0.3 | 20.7 | 0.0 | 18.6 | 2.0 | 0.2 | 0.5 | 0.0 | 0.3 | 2.4 | 0.2 |

TABLE 4

Fatty Acid Analysis of T2 bulk seed pools for events from *Arabidopsis* transformed with pKR1554 comprising MaD6Des, MaElo and CoMBOAT

| Event # | 16:0 | 18:0 | 18:1 | 18:2 | GLA | 18:3 | STA | 20:1 | EDA | DGLA | ERA | ETA | GLA + STA | EDA + ERA | DGLA + ETA |
|---|---|---|---|---|---|---|---|---|---|---|---|---|---|---|---|
| 10 | 10.4 | 3.6 | 9.0 | 7.6 | 22.2 | 7.3 | 6.3 | 13.2 | 2.3 | 13.0 | 1.3 | 4.0 | 28.5 | 3.5 | 17.0 |
| 3 | 10.9 | 4.0 | 17.5 | 2.3 | 13.7 | 14.9 | 3.6 | 17.7 | 2.8 | 9.1 | 1.5 | 2.2 | 17.3 | 4.4 | 11.2 |
| 2 | 11.1 | 3.9 | 18.8 | 1.2 | 17.5 | 2.9 | 18.5 | 3.2 | 8.4 | 1.4 | 4.6 | 10.3 |  |  |  |
| 13 | 8.1 | 3.2 | 12.1 | 17.1 | 13.2 | 13.1 | 4.1 | 14.7 | 2.9 | 7.6 | 1.8 | 2.1 | 17.3 | 4.7 | 9.7 |
| 9 | 9.1 | 3.4 | 14.9 | 20.3 | 8.5 | 13.4 | 2.3 | 15.0 | 2.7 | 7.4 | 1.3 | 1.8 | 10.8 | 4.0 | 9.2 |
| 4 | 11.3 | 3.7 | 14.1 | 2.3 | 18.2 | 15.9 | 5.5 | 16.3 | 2.4 | 7.2 | 1.3 | 1.9 | 23.6 | 3.7 | 9.1 |
| 14 | 9.9 | 3.6 | 12.8 | 17.6 | 14.7 | 12.6 | 3.6 | 14.1 | 2.1 | 6.6 | 0.9 | 1.5 | 18.3 | 3.0 | 8.2 |
| 7 | 9.4 | 3.3 | 13.1 | 19.4 | 12.9 | 13.7 | 3.6 | 13.1 | 2.3 | 6.4 | 1.2 | 1.6 | 16.6 | 3.5 | 8.0 |
| 5 | 8.9 | 3.1 | 12.2 | 17.9 | 14.4 | 13.2 | 3.9 | 15.1 | 2.3 | 6.1 | 1.2 | 1.5 | 18.4 | 3.6 | 7.6 |
| 11 | 7.6 | 3.2 | 12.5 | 18.8 | 10.9 | 15.1 | 3.3 | 16.8 | 3.0 | 5.6 | 1.8 | 1.5 | 14.2 | 4.7 | 7.1 |
| 8 | 8.8 | 3.3 | 10.9 | 19.6 | 11.1 | 15.7 | 3.6 | 16.3 | 2.6 | 5.2 | 1.3 | 1.5 | 14.7 | 3.9 | 6.7 |
| 1 | 8.2 | 2.9 | 15.1 | 27.0 | 0.2 | 13.8 | 0.0 | 13.3 | 9.6 | 4.3 | 4.8 | 1.0 | 0.2 | 14.4 | 5.2 |
| 12 | 8.4 | 2.9 | 11.6 | 23.3 | 7.6 | 18.5 | 2.3 | 17.1 | 2.8 | 3.1 | 1.4 | 0.9 | 10.0 | 4.2 | 4.0 |
| 6 | 8.6 | 3.1 | 15.0 | 22.4 | 10.3 | 17.5 | 3.0 | 17.1 | 1.9 | 0.4 | 0.6 | 0.0 | 13.3 | 2.4 | 0.4 |
| Avg.** | 9.9 | 3.6 | 14.4 | 9.7 | 13.8 | 13.2 | 3.8 | 15.8 | 2.8 | 9.1 | 1.5 | 2.4 | 17.6 | 4.2 | 11.5 |

A summary of the average fatty acid profiles for the five events having highest DGLA+ETA content from each experiment (Avg. \*\*) is shown in TABLE 5. In TABLE 5, the calculated % delta-6 desaturation conversion efficiency (% D6) is also shown for the average of the five events having highest DGLA+ETA content from each experiment where the % D6 was calculated by dividing the sum of the average weight percent (wt. %) for GLA, STA, DGLA and ETA by the sum of the average wt. % for 18:2, 18:3, GLA, STA, DGLA and ETA and multiplying by 100 to express as a %. Similarly, the calculated % $C_{18}$ to $C_{20}$ elongation conversion efficiency (% Elo) is shown in TABLE 5 for the average of the five events having highest DGLA+ETA content from each experiment where the % Elo was calculated by dividing the sum of the average weight percent (wt. %) for DGLA and ETA by the sum of the average wt. % for GLA, STA, DGLA and ETA and multiplying by 100 to express as a %. Also shown in TABLE 5 is the relative % desaturation (Rel % D6) and relative % elongation (Rel % Elo) for each experiment where the % D6 or % Elo for the experiment is divided by the % D6 or % Elo for that of pKR1559 (MaD6, MaElo).

TABLE 5

Comparison of the average fatty acid profiles for the 5 best events for MBOATs co-expressed with a *Mortiella alpina* delta-6 desaturase and *Mortiella alpina* elongase (delta-6 PUFA pathway) in *Arabidopsis*

| Experiment Avg.\*\* | 16:0 | 18:0 | 18:1 | 18:2 | GLA | 18:3 | STA | 20:1 | EDA | DGLA | ERA | ETA | % D6 | % Elo | Rel % D6 | Rel % Elo |
|---|---|---|---|---|---|---|---|---|---|---|---|---|---|---|---|---|
| pKR1559 (MaD6, MaElo) | 8.6 | 2.8 | 11.9 | 23.4 | 7.6 | 17.5 | 2.4 | 17.2 | 3.0 | 4.5 | 0.0 | 1.2 | 27.7 | 36.3 | 1.00 | 1.00 |
| pKR1552 (MaD6, MaElo, McMBOAT) | 9.0 | 3.4 | 11.4 | 13.9 | 14.2 | 9.8 | 4.1 | 12.2 | 3.2 | 13.4 | 1.9 | 3.5 | 59.8 | 49.0 | 2.16 | 1.35 |
| pKR1554 (MaD6, MaElo, CoMBOAT) | 9.9 | 3.6 | 14.4 | 9.7 | 13.8 | 13.2 | 3.8 | 15.8 | 2.8 | 9.1 | 1.5 | 2.4 | 55.8 | 40.2 | 2.02 | 1.11 |

TABLEs 2-5 demonstrate that co-expression of either McMBOAT or CoMBOAT along with MaD6Des and MaElo leads to higher % D6 and % Elo activity in *Arabidopsis* seed. % D6 and % Elo is higher with McMBOAT than with CoMBOAT and both are higher than without co-expression of an MBOAT.

Example 10

Co-Expressing EgD9Elo and TpomD8Des (Delta-9 Elongase Pathway) with McMBOAT or CoMBOAT in *Arabidopsis* Seed Plasmid DNA of pKR1022 (SEQ ID NO:73), comprising EgD9Elo and TpomD8Des, pKR1553 (SEQ ID NO:74), comprising EgD9Elo, TpomD8Des and McMBOAT, or pKR1555 (SEQ ID NO:75), comprising EgD9Elo, TpomD8Des and CoMBOAT, was transformed into *Arabidopsis*, transgenic plants were selected and grown, seeds were harvested and lipid fatty acid profiles were analyzed exactly as described in Example 9.

Results for fatty acid analysis of T2 bulk seed pools for individual events are summarized in TABLEs 6, 7, and 8, respectively. In the Tables, the fatty acid profiles as a weight percent of total fatty acids are shown exactly as described in Example 9.

TABLE 6

Fatty Acid Analysis of T2 bulk seed pools for events from *Arabidopsis* transformed with pKR1022 comprising EgD9Elo and TpomD8Des

| Event # | 16:0 | 18:0 | 18:1 | 18:2 | GLA | 18:3 | STA | 20:1 | EDA | DGLA | ERA | ETA | GLA + STA | EDA + ERA | DGLA + ETA |
|---|---|---|---|---|---|---|---|---|---|---|---|---|---|---|---|
| 16 | 9.0 | 2.8 | 15.2 | 22.2 | 0.2 | 10.5 | 0.0 | 12.4 | 10.1 | 8.9 | 6.0 | 2.6 | 0.2 | 16.2 | 11.5 |
| 6 | 8.1 | 2.9 | 17.2 | 26.1 | 0.2 | 14.7 | 0.0 | 14.9 | 6.5 | 4.8 | 3.4 | 1.2 | 0.2 | 9.9 | 6.1 |
| 4 | 7.6 | 2.7 | 18.0 | 25.7 | 0.1 | 14.6 | 0.0 | 15.3 | 6.4 | 4.5 | 3.7 | 1.4 | 0.1 | 10.1 | 5.9 |
| 17 | 7.2 | 2.9 | 17.1 | 27.2 | 0.0 | 13.4 | 0.0 | 16.7 | 7.5 | 3.6 | 3.7 | 0.8 | 0.0 | 11.1 | 4.3 |
| 7 | 8.3 | 3.0 | 14.8 | 27.7 | 0.1 | 14.3 | 0.0 | 15.5 | 8.0 | 3.4 | 4.2 | 0.8 | 0.1 | 12.2 | 4.2 |

TABLE 6-continued

Fatty Acid Analysis of T2 bulk seed pools for events from *Arabidopsis* transformed with pKR1022 comprising EgD9Elo and TpomD8Des

| Event # | 16:0 | 18:0 | 18:1 | 18:2 | GLA | 18:3 | STA | 20:1 | EDA | DGLA | ERA | ETA | GLA + STA | EDA + ERA | DGLA + ETA |
|---|---|---|---|---|---|---|---|---|---|---|---|---|---|---|---|
| 11 | 8.0 | 2.9 | 15.8 | 27.9 | 0.0 | 14.6 | 0.0 | 15.7 | 7.3 | 3.3 | 3.7 | 0.8 | 0.0 | 11.0 | 4.1 |
| 13 | 7.6 | 3.1 | 16.2 | 27.1 | 0.0 | 13.9 | 0.0 | 16.7 | 7.8 | 3.0 | 4.0 | 0.7 | 0.0 | 11.8 | 3.7 |
| 14 | 7.8 | 2.9 | 15.4 | 26.8 | 0.0 | 15.2 | 0.0 | 16.3 | 7.9 | 2.8 | 4.3 | 0.7 | 0.0 | 12.2 | 3.5 |
| 2 | 7.7 | 2.7 | 16.4 | 28.0 | 0.0 | 14.5 | 0.0 | 16.0 | 7.6 | 2.7 | 3.7 | 0.6 | 0.0 | 11.3 | 3.4 |
| 10 | 7.7 | 2.6 | 14.3 | 25.0 | 0.0 | 12.4 | 0.0 | 14.1 | 13.7 | 2.5 | 7.1 | 0.5 | 0.0 | 20.9 | 3.0 |
| 5 | 8.7 | 2.9 | 12.6 | 25.8 | 0.1 | 15.9 | 0.0 | 14.6 | 10.0 | 2.3 | 6.5 | 0.6 | 0.1 | 16.5 | 3.0 |
| 9 | 7.4 | 2.7 | 14.3 | 25.4 | 0.0 | 14.7 | 0.0 | 15.5 | 11.0 | 2.2 | 6.2 | 0.6 | 0.0 | 17.2 | 2.8 |
| 15 | 8.4 | 2.7 | 13.0 | 26.0 | 0.0 | 13.0 | 0.0 | 13.3 | 13.9 | 2.0 | 7.4 | 0.3 | 0.0 | 21.3 | 2.3 |
| 8 | 7.4 | 2.8 | 16.4 | 27.9 | 0.0 | 15.0 | 0.0 | 16.5 | 8.0 | 1.7 | 3.9 | 0.3 | 0.0 | 11.9 | 2.0 |
| 12 | 8.4 | 2.8 | 13.9 | 27.0 | 0.0 | 16.1 | 0.0 | 15.1 | 9.4 | 1.5 | 5.4 | 0.3 | 0.0 | 14.8 | 1.8 |
| 3 | 7.7 | 2.7 | 15.5 | 30.3 | 0.0 | 18.7 | 0.0 | 19.3 | 3.8 | 0.6 | 1.2 | 0.2 | 0.0 | 5.0 | 0.8 |
| 1 | 8.2 | 2.8 | 16.9 | 32.3 | 0.0 | 19.4 | 0.0 | 18.3 | 1.8 | 0.0 | 0.3 | 0.0 | 0.0 | 2.2 | 0.0 |
| Avg.** | 8.0 | 2.9 | 16.5 | 25.8 | 0.1 | 13.5 | 0.0 | 15.0 | 7.7 | 5.0 | 4.2 | 1.3 | 0.1 | 11.9 | 6.4 |

TABLE 7

Fatty Acid Analysis of T2 bulk seed pools for events from *Arabidopsis* transformed with pKR1553 comprising EgD9Elo, TpomD8Des and McMBOAT

| Event # | 16:0 | 18:0 | 18:1 | 18:2 | GLA | 18:3 | STA | 20:1 | EDA | DGLA | ERA | ETA | GLA + STA | EDA + ERA | DGLA + ETA |
|---|---|---|---|---|---|---|---|---|---|---|---|---|---|---|---|
| 10 | 9.1 | 2.8 | 17.6 | 22.0 | 0.3 | 8.8 | 0.0 | 10.0 | 10.2 | 11.5 | 5.0 | 2.8 | 0.3 | 15.1 | 14.3 |
| 9 | 9.6 | 3.1 | 15.4 | 21.9 | 0.2 | 10.0 | 0.0 | 11.3 | 11.6 | 8.7 | 5.9 | 2.4 | 0.2 | 17.5 | 11.0 |
| 12 | 9.6 | 2.8 | 17.0 | 24.9 | 0.0 | 12.1 | 0.0 | 11.7 | 7.7 | 9.0 | 3.3 | 1.9 | 0.0 | 11.0 | 10.9 |
| 1 | 8.7 | 3.1 | 14.0 | 22.9 | 0.0 | 11.2 | 0.0 | 11.2 | 11.8 | 8.1 | 6.8 | 2.2 | 0.0 | 18.6 | 10.3 |
| 7 | 9.6 | 3.0 | 14.7 | 24.4 | 0.0 | 12.8 | 0.0 | 11.6 | 9.6 | 7.3 | 5.0 | 2.0 | 0.0 | 14.6 | 9.3 |
| 2 | 8.6 | 2.7 | 16.1 | 27.9 | 0.0 | 11.4 | 0.0 | 12.9 | 9.0 | 6.6 | 3.5 | 1.4 | 0.0 | 12.5 | 8.0 |
| 4 | 8.2 | 3.0 | 14.5 | 26.5 | 0.0 | 15.0 | 0.0 | 14.0 | 8.2 | 4.6 | 4.7 | 1.2 | 0.0 | 12.9 | 5.8 |
| 8 | 8.5 | 2.7 | 17.3 | 28.8 | 0.2 | 15.0 | 0.0 | 15.3 | 4.9 | 3.8 | 2.4 | 1.1 | 0.2 | 7.3 | 4.9 |
| 11 | 8.9 | 2.9 | 14.0 | 27.5 | 0.4 | 15.6 | 0.0 | 12.8 | 8.5 | 3.9 | 4.6 | 0.9 | 0.4 | 13.1 | 4.8 |
| 3 | 8.3 | 2.9 | 15.1 | 28.0 | 0.0 | 14.9 | 0.0 | 13.4 | 8.6 | 3.6 | 4.4 | 0.8 | 0.0 | 13.0 | 4.4 |
| 13 | 8.4 | 2.4 | 17.3 | 31.9 | 0.0 | 16.2 | 0.0 | 16.2 | 4.5 | 1.4 | 1.6 | 0.0 | 0.0 | 6.0 | 1.4 |
| 5 | 8.2 | 2.7 | 15.8 | 31.6 | 0.0 | 21.1 | 0.0 | 17.8 | 2.1 | 0.0 | 0.6 | 0.0 | 0.0 | 2.7 | 0.0 |
| 6 | 8.2 | 2.7 | 14.3 | 27.2 | 0.0 | 14.1 | 0.0 | 12.3 | 14.7 | 0.0 | 6.4 | 0.0 | 0.0 | 21.2 | 0.0 |
| 14 | 8.4 | 2.6 | 16.7 | 33.5 | 0.0 | 19.4 | 0.0 | 17.3 | 1.8 | 0.0 | 0.4 | 0.0 | 0.0 | 2.1 | 0.0 |
| Avg.** | 9.3 | 2.9 | 15.7 | 23.2 | 0.1 | 11.0 | 0.0 | 11.2 | 10.2 | 8.9 | 5.2 | 2.3 | 0.1 | 15.4 | 11.2 |

TABLE 8

Fatty Acid Analysis of T2 bulk seed pools for events from *Arabidopsis* transformed with pKR1555 comprising EgD9Elo, TpomD8Des and CoMBOAT

| Event # | 16:0 | 18:0 | 18:1 | 18:2 | GLA | 18:3 | STA | 20:1 | EDA | DGLA | ERA | ETA | GLA + STA | EDA + ERA | DGLA + ETA |
|---|---|---|---|---|---|---|---|---|---|---|---|---|---|---|---|
| 7 | 8.3 | 2.8 | 17.9 | 23.3 | 0.2 | 10.5 | 0.0 | 12.0 | 9.3 | 7.9 | 5.2 | 2.5 | 0.2 | 14.5 | 10.4 |
| 3 | 8.5 | 3.0 | 16.4 | 25.6 | 0.2 | 13.0 | 0.0 | 14.1 | 7.7 | 5.9 | 4.1 | 1.6 | 0.2 | 11.8 | 7.5 |
| 20 | 8.6 | 2.9 | 13.3 | 24.9 | 0.3 | 12.6 | 0.1 | 12.9 | 11.0 | 5.6 | 6.1 | 1.6 | 0.4 | 17.0 | 7.2 |
| 6 | 8.7 | 3.1 | 14.1 | 25.6 | 0.1 | 13.1 | 0.1 | 13.8 | 9.8 | 5.2 | 5.1 | 1.3 | 0.2 | 14.9 | 6.6 |
| 11 | 7.4 | 2.6 | 16.9 | 27.0 | 0.1 | 13.4 | 0.0 | 14.5 | 7.9 | 5.0 | 4.0 | 1.3 | 0.2 | 11.9 | 6.2 |
| 17 | 7.8 | 3.2 | 14.6 | 26.5 | 0.1 | 14.3 | 0.0 | 16.0 | 7.8 | 4.1 | 4.6 | 1.1 | 0.1 | 12.4 | 5.2 |
| 19 | 7.4 | 3.2 | 15.3 | 26.4 | 0.1 | 14.3 | 0.0 | 16.1 | 7.6 | 4.2 | 4.4 | 1.1 | 0.2 | 12.0 | 5.2 |
| 10 | 7.8 | 2.8 | 16.5 | 27.7 | 0.1 | 14.9 | 0.0 | 15.5 | 6.5 | 3.8 | 3.2 | 1.1 | 0.1 | 9.7 | 4.8 |
| 18 | 7.9 | 3.3 | 14.2 | 29.0 | 0.1 | 14.8 | 0.0 | 15.2 | 6.8 | 3.7 | 3.9 | 1.1 | 0.1 | 10.8 | 4.8 |
| 15 | 7.7 | 3.1 | 14.7 | 27.0 | 0.1 | 16.0 | 0.1 | 16.2 | 6.6 | 3.7 | 3.9 | 1.1 | 0.1 | 10.5 | 4.7 |
| 8 | 8.1 | 3.0 | 14.2 | 26.5 | 0.1 | 14.0 | 0.1 | 14.2 | 9.9 | 3.6 | 5.5 | 0.9 | 0.1 | 15.4 | 4.5 |
| 16 | 8.1 | 2.9 | 14.1 | 27.8 | 0.1 | 16.1 | 0.1 | 15.5 | 7.1 | 3.5 | 3.8 | 0.9 | 0.1 | 11.0 | 4.4 |
| 1 | 7.6 | 2.8 | 15.2 | 27.5 | 0.1 | 14.7 | 0.0 | 15.8 | 7.7 | 3.5 | 4.2 | 0.9 | 0.1 | 11.9 | 4.3 |
| 5 | 7.9 | 3.3 | 15.6 | 27.2 | 0.1 | 15.8 | 0.0 | 15.4 | 6.6 | 3.3 | 3.9 | 0.9 | 0.1 | 10.5 | 4.2 |
| 21 | 7.8 | 3.0 | 13.9 | 26.3 | 0.1 | 15.0 | 0.0 | 16.0 | 8.6 | 3.4 | 4.9 | 0.8 | 0.1 | 13.5 | 4.2 |
| 9 | 7.9 | 2.9 | 14.8 | 28.0 | 0.0 | 14.5 | 0.0 | 16.5 | 7.7 | 2.9 | 4.0 | 0.7 | 0.0 | 11.8 | 3.6 |
| 12 | 8.2 | 3.0 | 14.0 | 28.2 | 0.0 | 15.8 | 0.1 | 15.6 | 7.6 | 2.8 | 4.0 | 0.7 | 0.1 | 11.6 | 3.5 |
| 2 | 7.9 | 2.7 | 13.5 | 25.8 | 0.1 | 14.8 | 0.1 | 13.7 | 11.9 | 2.1 | 6.8 | 0.5 | 0.2 | 18.7 | 2.7 |
| 4 | 7.3 | 2.7 | 15.9 | 31.3 | 0.3 | 20.2 | 0.0 | 19.5 | 2.2 | 0.2 | 0.5 | 0.0 | 0.3 | 2.6 | 0.2 |
| 13 | 6.8 | 2.3 | 14.5 | 28.1 | 0.0 | 12.9 | 0.0 | 14.3 | 14.6 | 0.1 | 6.2 | 0.0 | 0.0 | 20.8 | 0.1 |
| 14 | 7.2 | 2.7 | 15.5 | 29.0 | 0.0 | 22.2 | 0.1 | 20.2 | 2.3 | 0.1 | 0.7 | 0.0 | 0.1 | 3.0 | 0.1 |
| Avg.** | 8.3 | 2.9 | 15.7 | 25.3 | 0.2 | 12.5 | 0.0 | 13.5 | 9.1 | 5.9 | 4.9 | 1.7 | 0.3 | 14.0 | 7.6 |

A summary of the average fatty acid profiles for the five events having highest DGLA+ETA content from each experiment (Avg. **) is shown in TABLE 9. In TABLE 9, the calculated % delta-9 elongation conversion efficiency (% D9Elo) is also shown for the average of the five events having highest DGLA+ETA content from each experiment where the % D9Elo was calculated by dividing the sum of the average weight percent (wt. %) for EDA, ERA, DGLA and ETA by the sum of the average wt. % for 18:2, 18:3, EDA, ERA, DGLA and ETA and multiplying by 100 to express as a %. Similarly, the calculated % delta-8 desaturation conversion efficiency (% D8) is shown in TABLE 9 for the average of the five events having highest DGLA+ETA content from each experiment where the % D8 was calculated by dividing the sum of the average weight percent (wt. %) for DGLA and ETA by the sum of the average wt. % for EDA, ERA, DGLA and ETA and multiplying by 100 to express as a %. Also shown in TABLE 9 is the relative % delta-9 elongation (Rel % D9Elo) and relative % delta-8 desaturation (Rel % D8) for each experiment where the % D69Elo or % D8 for the experiment is divided by the % D9Elo or % D8 for that of pKR1022 (EgD9Elo, TpomD8Des).

acid [20:1(Δ11)], EDA is eicosadienoic acid [20:2(Δ11,14)] and ELEO is eleostearic acid. Results for each event are sorted according to elesteraric acid concentrations in decreasing order. The average fatty acid profiles for the five events having highest ELEO content from each experiment are also shown in each table (Avg. **) where only events having eleostearic acid greater than 1% are included in the average calculation. When fewer than five events had ELEO greater than 1% then only those events were used in the calculation. In TABLE 11, no events were obtained with ELEO greater than 1%.

TABLE 10

Fatty Acid Analysis of T2 bulk seed pools for events from *Arabidopsis* transformed with pKR539 comprising McConj

| Event # | 16:0 | 18:0 | 18:1 | 18:2 | 18:3 | 20:1 | EDA | ELEO |
|---|---|---|---|---|---|---|---|---|
| 8 | 9.3 | 3.5 | 35.3 | 23.1 | 7.3 | 15.0 | 0.8 | 5.7 |
| 3 | 8.8 | 3.1 | 26.2 | 27.0 | 14.7 | 16.7 | 1.3 | 2.3 |
| 12 | 8.1 | 2.7 | 22.6 | 30.4 | 14.9 | 17.8 | 1.6 | 1.9 |
| 20 | 8.1 | 2.8 | 29.1 | 27.2 | 13.5 | 17.2 | 0.9 | 1.2 |

TABLE 9

Comparison of the average fatty acid profiles of the five best events for MBOATs co-expressed with a delta-9 elongase and delta-8 desaturase (delta-9 elongase PUFA pathway) in *Arabidopsis*

| Experiment Avg. ** | 16:0 | 18:0 | 18:1 | 18:2 | GLA | 18:3 | STA | 20:1 | EDA | DGLA | ERA | ETA | % D9Elo | % D8 | Rel % D9Elo | Rel % D8 |
|---|---|---|---|---|---|---|---|---|---|---|---|---|---|---|---|---|
| pKR1022 (EgD9Elo, TpomD8Des) | 8.0 | 2.9 | 16.5 | 25.8 | 0.1 | 13.5 | 0.0 | 15.0 | 7.7 | 5.0 | 4.2 | 1.3 | 31.6 | 34.0 | 1.00 | 1.00 |
| pKR1553 (EgD9Elo TpomD8Des McMBOAT) | 9.3 | 2.9 | 15.7 | 23.2 | 0.1 | 11.0 | 0.0 | 11.2 | 10.2 | 8.9 | 5.2 | 2.3 | 43.6 | 42.3 | 1.38 | 1.25 |
| pKR1555 EgD9Elo TpomD8Des CoMBOAT | 8.3 | 2.9 | 15.7 | 25.3 | 0.2 | 12.5 | 0.0 | 13.5 | 9.1 | 5.9 | 4.9 | 1.7 | 36.3 | 35.1 | 1.15 | 1.03 |

TABLEs 6-9 demonstrate that co-expression of either McMBOAT or CoMBOAT along with MaD6Des and MaElo leads to higher % D9Elo activity in *Arabidopsis* seed. % D9Elo is higher with McMBOAT than with CoMBOAT and both are higher than without co-expression of an MBOAT. % D8 is also increased with McMBOAT.

Example 11

Co-Expressing McConj with McDGAT2 and/or McMBOAT in *Arabidopsis* Seed

Plasmid DNA of pKR539 (SEQ ID NO:52), comprising McConj, pKR1563 (SEQ ID NO:53), comprising McConj and McMBOAT, pKR1564 (SEQ ID NO:54), comprising McConj, McMBOAT and McDGAT2, or pKR1565 (SEQ ID NO:55), comprising McConj and McDGAT2, was transformed into *Arabidopsis*, transgenic plants were selected and grown, seeds were harvested and lipid fatty acid profiles were analyzed exactly as described in Example 9, Results for fatty acid analysis of T2 bulk seed pools for individual events are summarized in TABLES 10, 11, 12, and 13, respectively. In the Tables, the fatty acid profiles as a weight percent of total fatty acids are shown where 16:0 is palmitic acid, 18:0 is stearic acid, 18:1 is oleic acid, 18:2 is linoleic acid, 18:3 is alpha-linolenic acid, 20:1 is eicosenoic TABLE 10-continued Fatty Acid Analysis of T2 bulk seed pools for events from *Arabidopsis* transformed with pKR539 comprising McConj

| Event # | 16:0 | 18:0 | 18:1 | 18:2 | 18:3 | 20:1 | EDA | ELEO |
|---|---|---|---|---|---|---|---|---|
| 17 | 7.6 | 2.5 | 22.7 | 31.1 | 14.3 | 19.5 | 1.5 | 0.8 |
| 16 | 7.4 | 2.6 | 20.8 | 32.0 | 14.9 | 19.9 | 1.7 | 0.6 |
| 10 | 7.8 | 2.9 | 20.1 | 30.6 | 17.4 | 19.1 | 1.7 | 0.4 |
| 15 | 7.7 | 2.7 | 18.7 | 31.2 | 17.6 | 20.2 | 1.7 | 0.2 |
| 9 | 7.4 | 2.6 | 17.6 | 32.0 | 18.9 | 19.6 | 1.9 | 0.1 |
| 22 | 7.0 | 2.5 | 17.7 | 32.2 | 16.3 | 22.2 | 2.1 | 0.1 |
| 2 | 7.6 | 2.9 | 16.7 | 31.5 | 20.1 | 19.4 | 1.9 | 0.0 |
| 4 | 8.0 | 2.9 | 16.4 | 31.4 | 20.5 | 19.0 | 1.9 | 0.0 |
| 5 | 8.3 | 2.9 | 15.5 | 31.6 | 20.6 | 19.2 | 1.8 | 0.0 |
| 6 | 8.6 | 0.0 | 17.0 | 33.3 | 21.9 | 19.2 | 0.0 | 0.0 |
| 7 | 7.9 | 3.0 | 16.0 | 31.2 | 20.7 | 19.2 | 2.0 | 0.0 |
| 11 | 8.2 | 2.7 | 13.8 | 31.9 | 22.4 | 19.0 | 2.0 | 0.0 |
| 13 | 7.5 | 2.6 | 17.1 | 32.6 | 18.1 | 20.2 | 1.9 | 0.0 |
| 14 | 7.4 | 2.4 | 18.8 | 32.3 | 16.7 | 20.5 | 1.8 | 0.0 |
| 18 | 7.5 | 2.4 | 29.8 | 23.6 | 15.6 | 20.2 | 0.9 | 0.0 |
| 19 | 7.2 | 2.9 | 19.5 | 30.1 | 16.7 | 21.9 | 1.8 | 0.0 |
| 21 | 7.8 | 2.5 | 19.1 | 32.2 | 17.6 | 19.3 | 1.6 | 0.0 |
| Avg. ** | 8.6 | 3.0 | 28.3 | 26.9 | 12.6 | 16.7 | 1.1 | 2.8 |

TABLE 11

Fatty Acid Analysis of T2 bulk seed pools for events from *Arabidopsis* transformed with pKR1563 comprising McConj and McMBOAT

| Event # | 16:0 | 18:0 | 18:1 | 18:2 | 18:3 | 20:1 | EDA | ELEO |
|---|---|---|---|---|---|---|---|---|
| 9 | 7.7 | 3.0 | 24.3 | 28.9 | 17.2 | 16.8 | 1.4 | 0.8 |
| 18 | 8.6 | 2.6 | 17.4 | 32.3 | 19.6 | 17.5 | 1.7 | 0.4 |
| 1 | 7.5 | 2.4 | 20.4 | 34.4 | 15.9 | 17.8 | 1.6 | 0.0 |
| 2 | 8.5 | 2.8 | 15.9 | 32.7 | 20.5 | 17.6 | 1.9 | 0.0 |
| 3 | 7.7 | 2.8 | 14.7 | 32.3 | 21.2 | 19.1 | 2.2 | 0.0 |
| 4 | 13.5 | 2.6 | 15.0 | 36.0 | 19.7 | 11.7 | 1.4 | 0.0 |
| 5 | 7.6 | 2.5 | 17.4 | 34.1 | 18.9 | 17.4 | 1.9 | 0.0 |
| 6 | 8.1 | 2.9 | 16.2 | 32.0 | 20.3 | 18.4 | 2.0 | 0.0 |
| 7 | 8.0 | 2.9 | 15.4 | 31.7 | 21.3 | 18.6 | 2.0 | 0.0 |
| 8 | 9.1 | 2.9 | 13.1 | 33.4 | 22.1 | 17.3 | 2.1 | 0.0 |
| 10 | 7.4 | 2.2 | 18.1 | 34.9 | 17.7 | 18.0 | 1.8 | 0.0 |
| 11 | 7.8 | 2.2 | 17.4 | 34.8 | 17.9 | 17.9 | 1.9 | 0.0 |
| 12 | 8.0 | 2.4 | 16.4 | 32.4 | 19.5 | 19.4 | 1.9 | 0.0 |
| 13 | 7.8 | 2.4 | 16.5 | 31.9 | 20.7 | 18.9 | 1.7 | 0.0 |
| 14 | 8.9 | 2.7 | 13.9 | 31.9 | 22.3 | 18.4 | 1.9 | 0.0 |
| 15 | 7.7 | 2.3 | 18.0 | 34.4 | 17.7 | 18.1 | 1.8 | 0.0 |
| 16 | 7.5 | 2.4 | 18.2 | 33.0 | 17.3 | 19.9 | 1.7 | 0.0 |
| 17 | 7.6 | 2.2 | 17.9 | 32.9 | 18.8 | 18.8 | 1.7 | 0.0 |
| 19 | 7.7 | 2.3 | 17.8 | 35.5 | 17.7 | 17.1 | 1.8 | 0.0 |
| Avg. * | Nc** | Nc** | Nc** | Nc** | Nc** | Nc** | Nc** | Nc** |

Nc**—Not calculated. No events with >1% ELEO were obtained.

TABLE 12

Fatty Acid Analysis of T2 bulk seed pools for events from *Arabidopsis* transformed with pKR1564 comprising McConj, McMBOAT and McDGAT2

| Event # | 16:0 | 18:0 | 18:1 | 18:2 | 18:3 | 20:1 | EDA | ELEO |
|---|---|---|---|---|---|---|---|---|
| 2 | 9.0 | 3.1 | 29.0 | 26.9 | 10.6 | 16.1 | 1.2 | 4.1 |
| 7 | 10.2 | 2.9 | 19.5 | 29.6 | 13.3 | 15.5 | 7.2 | 1.8 |
| 3 | 8.5 | 3.0 | 21.6 | 29.7 | 19.5 | 15.2 | 1.5 | 1.0 |
| 4 | 8.1 | 2.8 | 18.3 | 32.6 | 18.3 | 17.7 | 1.8 | 0.5 |
| 1 | 8.1 | 3.0 | 16.5 | 32.1 | 19.8 | 18.6 | 1.9 | 0.0 |
| 5 | 8.2 | 2.9 | 16.0 | 32.2 | 20.4 | 18.5 | 2.0 | 0.0 |
| 6 | 8.0 | 2.6 | 18.8 | 32.6 | 18.5 | 18.1 | 1.5 | 0.0 |
| 8 | 8.1 | 2.4 | 18.9 | 33.5 | 17.9 | 17.7 | 1.6 | 0.0 |
| 9 | 8.2 | 2.4 | 16.2 | 33.7 | 20.2 | 17.5 | 1.8 | 0.0 |
| Avg. ** | 9.2 | 3.0 | 23.4 | 28.7 | 14.4 | 15.6 | 3.3 | 2.3 |

TABLE 13

Fatty Acid Analysis of T2 bulk seed pools for events from *Arabidopsis* transformed with pKR1565 comprising McConj and McDGAT2

| Event # | 16:0 | 18:0 | 18:1 | 18:2 | 18:3 | 20:1 | EDA | ELEO |
|---|---|---|---|---|---|---|---|---|
| 2 | 9.2 | 3.0 | 28.7 | 27.8 | 11.7 | 15.4 | 1.1 | 3.1 |
| 9 | 10.8 | 3.6 | 17.9 | 24.7 | 17.7 | 20.2 | 3.2 | 1.9 |
| 4 | 8.8 | 2.8 | 18.0 | 31.3 | 18.7 | 17.9 | 1.7 | 0.9 |
| 1 | 8.8 | 0.0 | 21.7 | 30.4 | 16.5 | 22.6 | 0.0 | 0.0 |
| 3 | 8.5 | 2.4 | 15.8 | 35.0 | 19.1 | 17.3 | 1.8 | 0.0 |
| 5 | 8.7 | 0.0 | 18.3 | 30.8 | 16.5 | 25.6 | 0.0 | 0.0 |
| 6 | 7.7 | 2.5 | 16.6 | 33.0 | 19.1 | 19.2 | 1.9 | 0.0 |
| 7 | 9.9 | 2.6 | 15.7 | 33.0 | 21.5 | 15.6 | 1.7 | 0.0 |
| 8 | 7.6 | 2.4 | 16.8 | 34.4 | 18.9 | 18.0 | 1.9 | 0.0 |
| 10 | 8.3 | 2.7 | 15.9 | 31.6 | 21.0 | 18.6 | 1.9 | 0.0 |
| Avg. ** | 10.0 | 3.3 | 23.3 | 26.3 | 14.7 | 17.8 | 2.2 | 2.5 |

A summary of the average fatty acid profiles for the five events having highest ELEO content from each experiment (Avg. **) is shown in TABLE 14. In TABLE 14, the calculated % conjugation conversion efficiency (% Conj) to Eleostearic acid (ELEO) is also shown for the average of the five events having highest ELEO content from each experiment where the % Conj was calculated by dividing the sum of the average weight percent (wt. %) for ELEO by the sum of the average wt. % for 18:2 and ELEO and multiplying by 100 to express as a %. Also shown in TABLE 14 is the relative % desaturation (Rel % Conj) for each experiment where the % Conj for the experiment is divided by the % Conj for that of pKR539 (McConj).

TABLE 14

Comparison of the average fatty acid profiles of the top 5 events for MBOAT and/or DGAT2 co-expressed with a *Momordica* conjugase in *Arabidopsis*

| Experiment | 16:0 | 18:0 | 18:1 | 18:2 | 18:3 | 20:1 | EDA | Eleo | % Conj | Rel % Conj |
|---|---|---|---|---|---|---|---|---|---|---|
| pKR539 (McConj) | 8.6 | 3.0 | 28.3 | 26.9 | 12.6 | 16.7 | 1.1 | 2.8 | 9.5 | 1.00 |
| pKR1563 (McConj, McMBOAT) | NC* | NC* | NC* | NC* | NC* | NC* | NC* | NC* | NC* | NC* |
| pKR1564 (McConj, McMBOAT, McDGAT2) | 9.2 | 3.0 | 23.4 | 28.7 | 14.4 | 15.6 | 3.3 | 2.3 | 7.5 | 0.79 |
| pKR1565 (McConj, McDGAT2) | 10.0 | 3.3 | 23.3 | 26.3 | 14.7 | 17.8 | 2.2 | 2.5 | 8.6 | 0.91 |

Co-expression of McMBOAT and/or McDGAT2 with McConj does not appear to give higher concentrations of ELEO in *Arabidopsis* seed.

Example 12

Co-Expressing CoConj with CoDGAT2 and/or CoMBOAT in *Arabidopsis* Seed

Plasmid DNA of pKR1507 (SEQ ID NO:56), comprising CoConj, pKR1508 (SEQ ID NO:57), comprising CoConj and CoMBOAT, pKR1509 (SEQ ID NO:58), comprising CoConj, CoMBOAT and CoDGAT2, or pKR1510 (SEQ ID NO:59), comprising CoConj and CoDGAT2, was transformed into *Arabidopsis*, transgenic plants were selected and grown, seeds were harvested and lipid fatty acid profiles were analyzed exactly as described in Example 9.

Results for fatty acid analysis of T2 bulk seed pools for individual events are summarized in TABLEs 15, 16, 17, and 18, respectively. In the Tables, the fatty acid profiles as a weight percent of total fatty acids are shown where 16:0 is palmitic acid, 18:0 is stearic acid, 18:1 is oleic acid, 18:2 is linoleic acid, 18:3 is alpha-linolenic acid, 20:1 is eicosenoic acid [20:1(Δ11)], EDA is eicosadienoic acid [20:2(Δ11,14)] and CAL is calendic acid. Results for each event are sorted according to calendic acid concentrations in decreasing order. The average fatty acid profiles for the five events having highest CAL content from each experiment are also shown in each table (Avg. **) where only events having calendic acid greater than 1% are included in the average calculation.

TABLE 15

Fatty Acid Analysis of T2 bulk seed pools for events from *Arabidopsis* transformed with pKR1507 comprising CoConj

| Event # | 16:0 | 18:0 | 18:1 | 18:2 | 18:3 | 20:1 | EDA | CAL |
|---|---|---|---|---|---|---|---|---|
| 17 | 7.9 | 3.1 | 18.1 | 24.0 | 17.8 | 20.6 | 1.5 | 7.1 |
| 14 | 8.4 | 3.3 | 18.6 | 24.5 | 18.3 | 19.4 | 1.3 | 6.2 |
| 21 | 7.5 | 2.9 | 17.0 | 25.4 | 19.4 | 20.2 | 1.7 | 5.9 |
| 3 | 7.1 | 3.0 | 18.9 | 24.6 | 18.9 | 20.4 | 1.5 | 5.7 |
| 20 | 8.1 | 2.9 | 17.2 | 25.6 | 19.3 | 19.9 | 1.6 | 5.5 |
| 19 | 7.6 | 3.0 | 18.5 | 24.9 | 18.4 | 20.9 | 1.6 | 5.1 |
| 6 | 7.7 | 3.1 | 17.3 | 25.5 | 20.6 | 19.3 | 1.5 | 5.1 |
| 24 | 7.6 | 3.0 | 17.8 | 24.6 | 20.3 | 20.3 | 1.6 | 5.0 |
| 9 | 7.3 | 2.8 | 15.7 | 26.4 | 19.5 | 21.4 | 2.0 | 4.8 |
| 11 | 7.6 | 2.9 | 16.1 | 27.0 | 20.3 | 19.7 | 1.7 | 4.6 |
| 10 | 8.4 | 2.9 | 17.9 | 27.2 | 19.9 | 18.0 | 1.5 | 4.1 |
| 15 | 7.7 | 2.8 | 14.0 | 26.3 | 22.9 | 20.4 | 2.0 | 3.7 |
| 23 | 7.8 | 3.1 | 15.7 | 27.5 | 20.8 | 19.7 | 1.8 | 3.6 |
| 4 | 8.7 | 3.1 | 14.7 | 26.9 | 23.0 | 18.3 | 1.8 | 3.5 |
| 22 | 8.2 | 2.9 | 15.2 | 29.0 | 21.4 | 18.1 | 1.7 | 3.5 |
| 16 | 8.0 | 2.9 | 16.4 | 27.6 | 21.2 | 18.9 | 1.8 | 3.2 |
| 18 | 8.3 | 2.9 | 15.2 | 29.1 | 21.4 | 18.4 | 1.7 | 2.9 |
| 5 | 7.9 | 2.9 | 16.0 | 28.2 | 21.2 | 19.2 | 1.8 | 2.8 |
| 12 | 8.4 | 2.9 | 16.5 | 28.4 | 20.8 | 18.4 | 1.7 | 2.8 |
| 7 | 8.2 | 3.1 | 15.3 | 28.3 | 21.4 | 19.2 | 1.9 | 2.6 |
| 2 | 8.3 | 2.9 | 16.0 | 28.2 | 20.9 | 19.6 | 1.7 | 2.4 |
| 1 | 7.8 | 3.2 | 15.4 | 27.4 | 21.1 | 21.0 | 1.8 | 2.4 |
| 13 | 7.0 | 2.9 | 15.4 | 27.5 | 21.1 | 22.0 | 2.0 | 2.2 |
| 8 | 8.4 | 3.0 | 16.1 | 29.0 | 21.4 | 18.2 | 1.7 | 2.1 |
| Avg. ** | 7.8 | 3.1 | 17.9 | 24.8 | 18.8 | 20.1 | 1.5 | 6.0 |

TABLE 16

Fatty Acid Analysis of T2 bulk seed pools for events from *Arabidopsis* transformed with pKR1508 comprising CoConj and CoMBOAT

| Event # | 16:0 | 18:0 | 18:1 | 18:2 | 18:3 | 20:1 | EDA | CAL |
|---|---|---|---|---|---|---|---|---|
| 4 | 7.3 | 3.1 | 19.9 | 22.9 | 17.6 | 20.4 | 1.3 | 7.6 |
| 21 | 6.6 | 3.2 | 17.6 | 24.0 | 18.0 | 23.3 | 1.8 | 5.6 |
| 18 | 7.9 | 3.1 | 19.1 | 25.5 | 17.7 | 19.7 | 1.5 | 5.4 |
| 22 | 7.4 | 3.3 | 18.6 | 25.6 | 17.1 | 21.2 | 1.6 | 5.3 |
| 16 | 7.0 | 3.1 | 19.1 | 25.1 | 17.6 | 21.2 | 1.6 | 5.2 |
| 3 | 7.5 | 2.9 | 17.7 | 27.0 | 19.2 | 18.9 | 1.7 | 5.0 |
| 14 | 7.0 | 3.1 | 18.1 | 25.6 | 19.2 | 20.7 | 1.7 | 4.5 |
| 10 | 7.4 | 3.1 | 18.4 | 25.6 | 19.2 | 20.4 | 1.7 | 4.4 |
| 13 | 7.1 | 2.9 | 17.8 | 27.6 | 18.8 | 19.6 | 1.7 | 4.4 |
| 11 | 7.1 | 3.1 | 17.9 | 27.6 | 18.3 | 20.1 | 1.8 | 4.1 |
| 7 | 7.6 | 3.0 | 17.4 | 27.7 | 19.2 | 19.3 | 1.7 | 4.1 |
| 6 | 7.9 | 2.8 | 17.0 | 28.5 | 20.5 | 17.6 | 1.7 | 4.0 |
| 8 | 7.7 | 2.9 | 16.6 | 29.0 | 18.9 | 19.3 | 1.7 | 3.9 |
| 12 | 7.5 | 3.0 | 18.0 | 28.1 | 18.9 | 18.9 | 1.7 | 3.8 |
| 19 | 7.4 | 3.0 | 17.4 | 27.4 | 18.8 | 20.5 | 1.8 | 3.6 |
| 9 | 7.4 | 3.0 | 17.0 | 28.7 | 19.2 | 19.4 | 1.8 | 3.5 |
| 5 | 7.9 | 2.8 | 17.2 | 29.6 | 19.3 | 18.2 | 1.7 | 3.3 |
| 20 | 7.9 | 3.3 | 16.7 | 28.0 | 20.5 | 18.9 | 1.8 | 2.9 |
| 23 | 7.3 | 3.0 | 15.6 | 28.3 | 19.5 | 21.4 | 2.0 | 2.8 |
| 15 | 6.7 | 2.7 | 18.2 | 28.5 | 18.4 | 20.9 | 1.9 | 2.7 |
| 1 | 7.3 | 2.9 | 17.0 | 27.8 | 21.0 | 19.5 | 1.8 | 2.7 |
| 2 | 8.7 | 3.0 | 14.6 | 30.1 | 21.5 | 18.3 | 1.8 | 2.0 |
| 17 | 7.5 | 3.0 | 16.5 | 29.2 | 19.3 | 20.5 | 1.9 | 2.0 |
| Avg. ** | 7.2 | 3.1 | 18.9 | 24.6 | 17.6 | 21.1 | 1.6 | 5.8 |

TABLE 17

Fatty Acid Analysis of T2 bulk seed pools for events from *Arabidopsis* transformed with pKR1509 comprising CoConj, CoMBOAT and CoDGAT2

| Event # | 16:0 | 18:0 | 18:1 | 18:2 | 18:3 | 20:1 | EDA | CAL |
|---|---|---|---|---|---|---|---|---|
| pKR1509-18 | 7.3 | 3.0 | 17.9 | 21.4 | 16.3 | 23.0 | 1.5 | 9.5 |
| pKR1509-14 | 8.1 | 3.2 | 18.0 | 23.1 | 16.3 | 21.1 | 1.5 | 8.8 |
| pKR1509-1 | 8.7 | 3.4 | 16.9 | 23.1 | 15.0 | 23.0 | 1.5 | 8.4 |
| pKR1509-5 | 8.2 | 3.2 | 17.7 | 24.0 | 16.8 | 20.3 | 1.5 | 8.3 |
| pKR1509-15 | 7.8 | 3.3 | 17.8 | 22.7 | 17.7 | 21.1 | 1.6 | 8.1 |
| pKR1509-16 | 7.9 | 3.2 | 17.7 | 23.4 | 18.4 | 19.8 | 1.6 | 7.9 |
| pKR1509-8 | 8.2 | 3.3 | 17.2 | 24.2 | 17.8 | 20.5 | 1.6 | 7.2 |
| pKR1509-12 | 7.5 | 3.1 | 18.0 | 24.6 | 16.6 | 21.3 | 1.6 | 7.2 |
| pKR1509-4 | 7.8 | 3.2 | 17.4 | 27.1 | 17.4 | 20.5 | 1.8 | 4.8 |
| pKR1509-17 | 8.0 | 3.0 | 15.9 | 27.3 | 19.2 | 20.0 | 1.9 | 4.8 |
| pKR1509-22 | 7.4 | 3.0 | 16.9 | 26.9 | 18.7 | 20.6 | 1.8 | 4.6 |
| pKR1509-11 | 8.4 | 3.2 | 15.8 | 28.5 | 19.1 | 19.0 | 1.7 | 4.2 |
| pKR1509-2 | 6.8 | 2.9 | 16.1 | 26.6 | 19.4 | 22.4 | 2.0 | 3.7 |
| pKR1509-20 | 8.1 | 3.1 | 16.7 | 28.7 | 18.8 | 19.1 | 1.8 | 3.6 |
| pKR1509-7 | 8.1 | 3.0 | 17.1 | 28.5 | 19.0 | 19.0 | 1.7 | 3.6 |
| pKR1509-6 | 7.2 | 2.8 | 15.9 | 28.8 | 18.4 | 21.3 | 2.0 | 3.6 |
| pKR1509-13 | 8.0 | 3.1 | 16.5 | 28.2 | 19.9 | 19.2 | 1.8 | 3.3 |
| pKR1509-9 | 8.0 | 3.0 | 15.0 | 28.8 | 20.1 | 20.2 | 2.0 | 2.8 |
| pKR1509-19 | 8.4 | 3.0 | 16.1 | 30.7 | 18.7 | 18.9 | 1.9 | 2.3 |
| pKR1509-3 | 8.0 | 2.9 | 16.2 | 29.5 | 20.1 | 19.3 | 1.9 | 2.0 |
| pKR1509-21 | 8.6 | 3.1 | 15.2 | 29.6 | 21.0 | 18.8 | 1.9 | 1.9 |
| pKR1509-23 | 8.4 | 3.1 | 16.8 | 30.2 | 20.2 | 17.7 | 1.8 | 1.8 |
| pKR1509-10 | 6.8 | 2.9 | 15.9 | 30.1 | 19.7 | 22.1 | 2.2 | 0.2 |
| Avg. ** | 8.0 | 3.2 | 17.6 | 22.9 | 16.4 | 21.7 | 1.5 | 8.6 |

TABLE 18

Fatty Acid Analysis of T2 bulk seed pools for events from *Arabidopsis* transformed with pKR1510 comprising CoConj and CoDGAT2. pKR1510 (CoConj, CoDGAT2)

| Event # | 16:0 | 18:0 | 18:1 | 18:2 | 18:3 | 20:1 | EDA | CAL |
|---|---|---|---|---|---|---|---|---|
| 13 | 7.6 | 3.3 | 19.1 | 21.6 | 17.5 | 21.6 | 1.4 | 8.0 |
| 1 | 7.4 | 3.1 | 17.8 | 22.4 | 18.0 | 21.8 | 1.6 | 7.9 |
| 22 | 8.1 | 3.0 | 16.9 | 23.2 | 19.4 | 20.1 | 1.6 | 7.8 |
| 14 | 8.5 | 3.3 | 17.0 | 24.0 | 18.5 | 20.5 | 1.6 | 6.6 |
| 5 | 7.5 | 2.9 | 18.2 | 25.4 | 18.7 | 20.0 | 1.6 | 5.8 |
| 21 | 7.4 | 2.8 | 15.3 | 25.5 | 20.2 | 21.2 | 1.8 | 5.7 |
| 11 | 8.9 | 3.3 | 18.6 | 25.3 | 16.1 | 21.0 | 1.6 | 5.2 |
| 24 | 8.0 | 3.3 | 17.0 | 26.5 | 19.7 | 19.0 | 1.7 | 4.9 |
| 9 | 7.6 | 3.1 | 16.2 | 27.0 | 19.5 | 20.2 | 1.8 | 4.5 |
| 20 | 8.3 | 3.1 | 14.8 | 28.0 | 20.4 | 19.1 | 1.9 | 4.4 |
| 17 | 8.0 | 3.3 | 15.0 | 28.3 | 20.1 | 19.5 | 2.0 | 3.8 |
| 16 | 8.0 | 2.8 | 15.6 | 27.2 | 21.3 | 19.6 | 1.8 | 3.6 |
| 23 | 8.5 | 3.0 | 15.8 | 28.0 | 20.5 | 18.9 | 2.0 | 3.3 |
| 18 | 8.0 | 3.0 | 16.9 | 28.8 | 20.1 | 18.4 | 1.7 | 2.9 |
| 3 | 7.6 | 3.0 | 16.6 | 28.4 | 19.5 | 20.2 | 1.9 | 2.8 |
| 10 | 7.9 | 3.0 | 16.3 | 28.7 | 20.6 | 19.0 | 1.9 | 2.6 |
| 19 | 7.6 | 2.9 | 16.7 | 29.1 | 19.8 | 19.8 | 1.9 | 2.3 |
| 2 | 8.5 | 3.3 | 15.5 | 29.6 | 20.2 | 18.9 | 1.8 | 2.2 |
| 7 | 7.9 | 2.8 | 16.2 | 29.7 | 19.9 | 19.5 | 1.9 | 2.2 |
| 6 | 8.2 | 3.0 | 14.6 | 30.1 | 21.0 | 19.1 | 2.0 | 1.9 |
| 15 | 7.8 | 3.0 | 14.5 | 29.1 | 21.1 | 20.6 | 2.0 | 1.9 |
| 8 | 8.2 | 2.9 | 16.3 | 30.0 | 20.4 | 18.6 | 1.8 | 1.7 |
| 4 | 8.5 | 3.1 | 15.5 | 31.1 | 21.0 | 18.7 | 2.0 | 0.0 |
| 12 | 8.5 | 3.1 | 16.0 | 32.0 | 20.7 | 17.8 | 1.8 | 0.0 |
| Avg. ** | 7.8 | 3.1 | 17.8 | 23.3 | 18.4 | 20.8 | 1.5 | 7.2 |

A summary of the average fatty acid profiles for the five events having highest CAL content from each experiment (Avg. **) is shown in TABLE 19. In TABLE 19, the calculated % conjugation conversion efficiency (% Conj) to Calendic acid (CAL) is also shown for the average of the five events having highest CAL content from each experiment where the % Conj was calculated by dividing the sum of the average weight percent (wt. %) for CAL by the sum of the average wt. % for 18:2 and CAL and multiplying by 100 to express as a %. Also shown in TABLE 19 is the relative % desaturation (Rel % Conj) for each experiment where the % Conj for the experiment is divided by the % Conj for that of pKR1507 (CoConj).

TABLE 19

Comparing average fatty acid profiles for MBOATs co-expressed with a *Calendula* conjugase in *Arabidopsis*

| Experiment | 16:0 | 18:0 | 18:1 | 18:2 | 18:3 | 20:1 | EDA | Cal | % Conj | Rel % Conj |
|---|---|---|---|---|---|---|---|---|---|---|
| pKR1507 (CoConj) | 7.8 | 3.1 | 17.9 | 24.8 | 18.8 | 20.1 | 1.5 | 6.0 | 19.6 | 2.06 |
| pKR1508 (CoConj, CoMBOAT) | 7.2 | 3.1 | 18.9 | 24.6 | 17.6 | 21.1 | 1.6 | 5.8 | 19.1 | 2.01 |
| pKR1509 (CoConj, CoMBOAT, CoDGAT2) | 8.0 | 3.2 | 17.6 | 22.9 | 16.4 | 21.7 | 1.5 | 8.6 | 27.4 | 2.88 |
| pKR1510 (CoConj, CoDGAT2) | 7.8 | 3.1 | 17.8 | 23.3 | 18.4 | 20.8 | 1.5 | 7.2 | 23.7 | 2.49 |

Co-expression of CoMBOAT with CoConj does not appear to give higher concentrations of CAL in *Arabidopsis* seed.
Co-expression of CoDGAT or CoMBOAT and CoDGAT2 with CoConj increases the % Conj activity which leads to higher concentrations of CAL in seed.

Example 13

Co-Expressing McConj with McDGAT2 and/or McMBOAT in Soy Somatic Embryos

Soybean expression vectors pKR458 (SEQ ID NO:31), comprising McConj, pKR1548 (SEQ ID NO:35), comprising McConj and McMBOAT, pKR1556 (SEQ ID NO:36), comprising McConj, McMBOAT and McDGAT2, and pKR1562 (SEQ ID NO:37), comprising McConj and McDGAT2 were transformed into soy and lipid fatty acid profiles were analyzed as described below.

Culture Conditions:

Soybean embryogenic suspension cultures (cv. Jack) were maintained in 35 mL liquid medium SB196 (infra) on a rotary shaker, 150 rpm, 26° C. with cool white fluorescent lights on 16:8 h day/night photoperiod at light intensity of 60-85 µE/m²/s. Cultures were subcultured every 7 days to two weeks by inoculating approximately 35 mg of tissue into 35 mL of fresh liquid SB196 (the preferred subculture interval is every 7 days).

Soybean embryogenic suspension cultures were transformed with the soybean expression plasmids by the method of particle gun bombardment (Klein et al., *Nature* 327:70 (1987)) using a DuPont Biolistic PDS1000/HE instrument (helium retrofit) for all transformations.

Soybean Embryogenic Suspension Culture Initiation:

Soybean cultures were initiated twice each month with 5-7 days between each initiation. Pods with immature seeds from available soybean plants 45-55 days after planting were picked, removed from their shells and placed into a sterilized magenta box. The soybean seeds were sterilized by shaking them for 15 min in a 5% Clorox solution with 1 drop of ivory soap (i.e., 95 mL of autoclaved distilled water plus 5 mL Clorox and 1 drop of soap, mixed well). Seeds were rinsed using 2 1-liter bottles of sterile distilled water, and those less than 4 mm were placed on individual microscope slides. The small end of the seed was cut and the cotyledons pressed out of the seed coat. Cotyledons were transferred to plates containing SB199 medium (25-30 cotyledons per plate) for 2 weeks, then transferred to SB1 for 2-4 weeks. Plates were wrapped with fiber tape. After this time, secondary embryos were cut and placed into SB196 liquid media for 7 days.

Preparation of DNA for Bombardment:

A 50 µL aliquot of sterile distilled water containing 1 mg of gold particles was added to 5 µL of a 1 µg/µL DNA solution (intact expression vector as described herein), 50 µL 2.5M CaCl$_2$ and 20 µL of 0.1 M spermidine. The mixture was pulsed 5 times on level 4 of a vortex shaker and spun for 5 sec in a bench microfuge. After a wash with 150 µL of 100% ethanol, the pellet was suspended by sonication in 85 µL of 100% ethanol. Five µL of DNA suspension was dispensed to each flying disk of the Biolistic PDS1000/HE instrument disk. Each 5 µL aliquot contained approximately 0.058 mg gold particles per bombardment (i.e., per disk).

Tissue Preparation and Bombardment with DNA:

Approximately 100-150 mg of 7 day old embryonic suspension cultures were placed in an empty, sterile 60×15 mm petri dish and the dish was placed inside of an empty 150×25 mm Petri dish. Tissue was bombarded 1 shot per plate with membrane rupture pressure set at 650 PSI, and the chamber was evacuated to a vacuum of 27-28 inches of mercury. Tissue was placed approximately 2.5 inches from the retaining/stopping screen.

Selection of Transformed Embryos:

Transformed embryos were selected using hygromycin as the selectable marker. Specifically, following bombardment, the tissue was placed into fresh SB196 media and cultured as described above. Six to eight days post-bombardment, the SB196 is exchanged with fresh SB196 containing 30 mg/L hygromycin. The selection media was refreshed weekly. Four to six weeks post-selection, green, transformed tissue was observed growing from untransformed, necrotic embryogenic clusters. Isolated, green tissue was removed and inoculated into multi-well plates to generate new, clonally propagated, transformed embryogenic suspension cultures.

Embryo Maturation:

Transformed embryogenic clusters were removed to SB228 (SHaM) liquid media, 35 mL in 250 mL Erlenmeyer flask, and grown for 2-3 weeks. Tissue cultured in SB228 was maintained on a rotary shaker, 130 rpm, 26° C. with cool white fluorescent lights on 16:8 h day/night photoperiod at light intensity of 60-85 µE/m²/s. After this period, embryos were analyzed for alterations in their fatty acid compositions as described supra.

Media Recipes:

SB 196—FN Lite Liquid Proliferation Medium (per Liter)

| MS FeEDTA - 100x Stock 1 | 10 mL |
| MS Sulfate - 100x Stock 2 | 10 mL |

-continued

| | | |
|---|---|---|
| FN Lite Halides - 100x Stock 3 | 10 | mL |
| FN Lite P, B, Mo - 100x Stock 4 | 10 | mL |
| B5 vitamins (1 mL/L) | 1.0 | mL |
| 2,4-D (10 mg/L final concentration) | 1.0 | mL |
| $KNO_3$ | 2.83 | gm |
| $(NH_4)_2SO_4$ | 0.463 | gm |
| Asparagine | 1.0 | gm |
| Sucrose (1%) | 10 | gm |
| pH 5.8 | | |

FN Lite Stock Solutions

| | Stock Number | 1000 mL | 500 mL |
|---|---|---|---|
| 1 | MS Fe EDTA 100x Stock | | |
| | $Na_2$ EDTA* | 3.724 g | 1.862 g |
| | $FeSO_4$—$7H_2O$ | 2.784 g | 1.392 g |
| 2 | MS Sulfate 100x stock | | |
| | $MgSO_4$—$7H_2O$ | 37.0 g | 18.5 g |
| | $MnSO_4$—$H_2O$ | 1.69 g | 0.845 g |
| | $ZnSO_4$—$7H_2O$ | 0.86 g | 0.43 g |
| | $CuSO_4$—$5H_2O$ | 0.0025 g | 0.00125 g |
| 3 | FN Lite Halides 100x Stock | | |
| | $CaCl_2$—$2H_2O$ | 30.0 g | 15.0 g |
| | KI | 0.083 g | 0.0715 g |
| | $CoCl_2$—$6H_2O$ | 0.0025 g | 0.00125 g |
| 4 | FN Lite P, B, Mo 100x Stock | | |
| | $KH_2PO_4$ | 18.5 g | 9.25 g |
| | $H_3BO_3$ | 0.62 g | 0.31 g |
| | $Na_2MoO_4$—$2H_2O$ | 0.025 g | 0.0125 g |

*Add first, dissolve in dark bottle while stirring

SB1 Solid Medium (per Liter)

1 package MS salts (Gibcol BRL—Cat. No. 11117-066)
1 mL B5 vitamins 1000× stock
31.5 g Glucose
2 mL 2,4-D (20 mg/L final concentration)
pH 5.7
8 g TC agar SB199 Solid Medium (per Liter)

1 package MS salts (Gibco/BRL—Cat. No. 11117-066)
1 mL B5 vitamins 1000× stock
30 g Sucrose
4 ml 2,4-D (40 mg/L final concentration)
pH 7.0
2 gm Gelrite SB 166 Solid Medium (per Liter)

1 package MS salts (Gibco/BRL—Cat. No. 11117-066)
1 mL B5 vitamins 1000× stock
60 g maltose
750 mg $MgCl_2$ hexahydrate
5 g Activated charcoal
pH 5.7
2 g Gelrite SB 103 Solid Medium (per Liter)

1 package MS salts (Gibco/BRL—Cat. No. 11117-066)
1 mL B5 vitamins 1000× stock
60 g maltose
750 mg $MgCl_2$ hexahydrate
pH 5.7
2 g Gelrite SB 71-4 Solid Medium (per Liter)

1 bottle Gamborg's B5 salts w/sucrose (Gibco/BRL—Cat. No. 21153-036)
pH 5.7
5 g TC agar B5 Vitamins Stock (Per 100 mL)

Store aliquots at −20° C.
10 g Myo-inositol
100 mg Nicotinic acid
100 mg Pyridoxine HCl
1 g Thiamine
If the solution does not dissolve quickly enough, apply a low level of heat via the hot stir plate.

SB 228—Soybean Histodifferentiation & Maturation (SHaM) (per Liter)

| | |
|---|---|
| DDI $H_2O$ | 600 ml |
| FN-Lite Macro Salts for SHaM 10X | 100 ml |
| MS Micro Salts 1000x | 1 ml |
| MS FeEDTA 100x | 10 ml |
| CaCl 100x | 6.82 ml |
| B5 Vitamins 1000x | 1 ml |
| L-Methionine | 0.149 g |
| Sucrose | 30 g |
| Sorbitol | 30 g |
| Adjust volume to 900 mL | |
| pH 5.8 | |
| Autoclave | |
| Add to cooled media (≤30° C.): | |
| *Glutamine (Final conc. 30 mM) 4% | 110 mL |

*Note:
Final volume will be 1010 mL after glutamine addition.

Because glutamine degrades relatively rapidly, it may be preferable to add immediately prior to using media. Expiration 2 weeks after glutamine is added; base media can be kept longer w/o glutamine.

FN-Lite Macro for SHAM 10×—Stock #1 (per Liter)

| | |
|---|---|
| $(NH_4)_2SO_4$ (Ammonium Sulfate) | 4.63 g |
| $KNO_3$ (Potassium Nitrate) | 28.3 g |
| $MgSO_4$*$7H_2O$ (Magnesium Sulfate Heptahydrate) | 3.7 g |
| $KH_2PO_4$ (Potassium Phosphate, Monobasic) | 1.85 g |
| Bring to volume | |
| Autoclave | |

MS Micro 1000×—Stock #2 (per 1 liter)

| | |
|---|---|
| $H_3BO_3$ (Boric Acid) | 6.2 g |
| $MnSO_4$*$H_2O$ (Manganese Sulfate Monohydrate) | 16.9 g |
| $ZnSO_4$*$7H_2O$ (Zinc Sulfate Heptahydrate) | 8.6 g |

59

-continued

| | |
|---|---|
| Na$_2$MoO$_4$*2H$_2$O (Sodium Molybdate Dihydrate) | 0.25 g |
| CuSO$_4$*5H$_2$O (Copper Sulfate Pentahydrate) | 0.025 g |
| CoCl$_2$*6H$_2$O (Cobalt Chloride Hexahydrate) | 0.025 g |
| KI (Potassium Iodide) | 0.8300 g |
| Bring to volume | |
| Autoclave | |

FeEDTA 100×—Stock #3 (per liter)

| | |
|---|---|
| Na$_2$EDTA* (Sodium EDTA) | 3.73 g |
| FeSO$_4$*7H$_2$O (Iron Sulfate Heptahydrate) | 2.78 g |
| Bring to Volume | |
| Solution is photosensitive. Bottle(s) should be wrapped in foil to omit light. | |
| Autoclave | |

*EDTA must be completely dissolved before adding iron.

Ca 100×—Stock #4 (per liter)

| | |
|---|---|
| CaCl$_2$*2H$_2$O (Calcium Chloride Dihydrate) | 44 g |
| Bring to Volume | |
| Autoclave | |

B5 Vitamin 1000×—Stock #5 (per Liter)

| | |
|---|---|
| Thiamine*HCl | 10 g |
| Nicotinic Acid | 1 g |
| Pyridoxine*HCl | 1 g |
| Myo-Inositol | 100 g |
| Bring to Volume | |
| Store frozen | |

4% Glutamine—Stock #6 (per Liter)

| | |
|---|---|
| DDI water heated to 30° C. | 900 ml |
| L-Glutamine | 40 g |
| Gradually add while stirring and applying low heat. | |
| Do not exceed 35° C. | |
| Bring to Volume | |
| Filter Sterilize | |
| Store frozen* | |

*Note:
Warm thawed stock in 31° C. bath to fully dissolve crystals.

Lipid Fatty Acid Analysis:

Somatic embryos were harvested after two weeks of culture in the liquid maturation medium SB228 (SHaM) liquid media. Approximately 30 events from each transformation with soybean expression vectors pKR458 (SEQ ID NO:31), comprising McConj, pKR1548 (SEQ ID NO:35), comprising McConj and McMBOAT, pKR1556 (SEQ ID NO:36), comprising McConj, McMBOAT and McDGAT2, and pKR1562 (SEQ ID NO:37), comprising McConj and McDGAT2 were analyzed. Embryos generated for a given event were harvested in bulk, frozen in a −80° C. freezer and dried by lyophilization for 48 h.

Dried embryos from each event were ground to a fine powder using a genogrinder vial (½"×2" polycarbonate) and a steel ball (SPEX Centriprep (Metuchen, N.J., U.S.A.). Grinding time was 30 sec at 1450 oscillations per min. Lipids were transesterified from approximately 50 mg of dried, ground embryo powder with TMSH for 15 min and FAMEs were extracted into 400 µL of heptane and analyzed by GC as described for Arabidopsis seed herein.

Fatty acid profiles for approximately 30 events from each transformation with soybean expression vectors pKR458 (SEQ ID NO:31), comprising McConj and called experiment MSE2594, pKR1548 (SEQ ID NO:35), comprising McConj and McMBOAT and called experiment MSE2591, pKR1556 (SEQ ID NO:36), comprising McConj, McMBOAT and McDGAT2 and called experiment MSE2592, and pKR1562 (SEQ ID NO:37), comprising McConj and McDGAT2 and called experiment MSE2593 are summarized in TABLES 20, 21, 22, and 23, respectively.

In the Tables, the fatty acid profiles as a weight percent of total fatty acids are shown where 16:0 is palmitic acid, 18:0 is stearic acid, 18:1 is oleic acid, 18:2 is linoleic acid, 18:3 is alpha-linolenic acid and ELEO is eleostearic acid. Results for each event are sorted according to ELEO concentrations in decreasing order. The average fatty acid profiles for the five events having highest ELEO content from each experiment are also shown in each table (Avg. **) where only events having eleostearic acid greater than 1% are included in the average calculation.

TABLE 20

Fatty Acid Analysis from Soy Somatic Embyros transformed with pKR458 comprising McConj (MSE2594)

| Event # | 16:0 | 18:0 | 18:1 | 18:2 | 18:3 | ELEO |
|---|---|---|---|---|---|---|
| 17 | 12.9 | 4.3 | 43.1 | 26.0 | 7.1 | 6.7 |
| 9 | 12.6 | 3.8 | 29.8 | 38.5 | 9.7 | 5.7 |
| 29 | 14.3 | 3.5 | 29.8 | 36.7 | 11.3 | 4.3 |
| 11 | 13.7 | 3.7 | 33.8 | 33.1 | 11.7 | 4.0 |
| 26 | 15.0 | 4.0 | 29.1 | 37.1 | 11.5 | 3.3 |
| 10 | 15.7 | 4.6 | 26.0 | 38.4 | 12.1 | 3.3 |
| 12 | 17.5 | 6.1 | 20.1 | 38.2 | 16.4 | 1.7 |
| 27 | 15.6 | 4.8 | 32.4 | 36.0 | 9.6 | 1.7 |
| 2 | 15.2 | 4.6 | 27.6 | 39.1 | 12.3 | 1.2 |
| 23 | 16.6 | 4.8 | 26.7 | 36.1 | 14.6 | 1.2 |
| 30 | 16.5 | 4.2 | 17.8 | 42.9 | 17.4 | 1.1 |
| 19 | 17.7 | 4.1 | 15.3 | 46.5 | 15.7 | 0.7 |
| 28 | 16.8 | 4.6 | 21.6 | 39.9 | 16.7 | 0.4 |
| 1 | 16.6 | 4.9 | 20.0 | 41.0 | 17.5 | 0.0 |
| 3 | 16.2 | 6.4 | 18.7 | 40.5 | 18.2 | 0.0 |
| 4 | 17.3 | 4.2 | 18.1 | 43.8 | 16.7 | 0.0 |
| 5 | 18.0 | 4.2 | 15.9 | 43.1 | 18.8 | 0.0 |
| 6 | 18.1 | 5.1 | 16.1 | 39.6 | 21.2 | 0.0 |
| 7 | 18.4 | 4.8 | 16.3 | 36.2 | 24.4 | 0.0 |
| 8 | 17.5 | 5.1 | 17.3 | 40.0 | 20.1 | 0.0 |
| 13 | 18.0 | 4.6 | 17.1 | 41.1 | 19.2 | 0.0 |
| 14 | 16.4 | 4.8 | 23.0 | 41.8 | 14.0 | 0.0 |
| 15 | 16.9 | 4.7 | 21.0 | 40.5 | 17.0 | 0.0 |
| 16 | 18.8 | 4.3 | 15.0 | 44.5 | 17.4 | 0.0 |
| 18 | 17.9 | 5.8 | 21.1 | 38.7 | 16.5 | 0.0 |
| 20 | 19.0 | 4.8 | 13.2 | 40.3 | 22.6 | 0.0 |
| 21 | 17.6 | 4.7 | 17.4 | 41.0 | 19.3 | 0.0 |
| 22 | 19.1 | 4.4 | 12.9 | 40.1 | 23.4 | 0.0 |
| 24 | 16.7 | 5.0 | 21.4 | 40.0 | 17.0 | 0.0 |
| 25 | 16.4 | 5.1 | 23.2 | 39.7 | 15.6 | 0.0 |
| Avg. ** | 13.7 | 3.9 | 33.1 | 34.3 | 10.3 | 4.8 |

TABLE 21

Fatty Acid Analysis from Soy Somatic Embyros transformed with pKR1548 comprising McConj and McMBOAT (MSE2591)
MSE2591 (McConj, McMBOAT)

| Event # | 16:0 | 18:0 | 18:1 | 18:2 | 18:3 | Eleo |
|---|---|---|---|---|---|---|
| 26 | 10.7 | 3.2 | 50.3 | 22.9 | 4.9 | 7.9 |
| 17 | 11.6 | 3.5 | 45.2 | 27.0 | 5.2 | 7.5 |
| 5 | 12.1 | 3.4 | 43.4 | 28.1 | 5.7 | 7.4 |
| 4 | 12.6 | 3.7 | 46.2 | 23.9 | 7.4 | 6.2 |
| 21 | 11.9 | 3.7 | 43.8 | 26.9 | 7.9 | 5.8 |
| 7 | 14.3 | 3.9 | 34.5 | 31.3 | 10.3 | 5.7 |
| 19 | 12.2 | 4.0 | 47.4 | 24.6 | 6.2 | 5.6 |
| 20 | 13.1 | 4.0 | 39.5 | 28.7 | 9.2 | 5.4 |
| 8 | 12.8 | 4.1 | 39.4 | 29.9 | 8.7 | 5.0 |
| 23 | 13.0 | 4.3 | 39.9 | 30.2 | 8.2 | 4.5 |
| 2 | 12.5 | 3.8 | 34.5 | 30.5 | 14.3 | 4.4 |
| 14 | 13.5 | 3.8 | 32.8 | 33.2 | 12.7 | 3.9 |
| 15 | 15.5 | 5.0 | 27.8 | 33.9 | 15.0 | 2.9 |
| 22 | 14.6 | 5.0 | 36.0 | 31.8 | 10.0 | 2.6 |
| 16 | 14.6 | 5.3 | 33.6 | 35.8 | 8.5 | 2.2 |
| 10 | 14.7 | 5.0 | 34.1 | 32.2 | 11.8 | 2.1 |
| 25 | 16.5 | 5.5 | 28.4 | 33.7 | 14.2 | 1.8 |
| 3 | 16.4 | 4.8 | 27.6 | 34.3 | 15.4 | 1.5 |
| 27 | 15.8 | 4.9 | 25.0 | 37.9 | 15.0 | 1.3 |
| 24 | 15.4 | 5.5 | 33.6 | 35.8 | 8.7 | 1.0 |
| 30 | 15.4 | 5.5 | 39.0 | 30.6 | 8.8 | 0.8 |
| 1 | 18.8 | 5.2 | 16.7 | 35.4 | 24.0 | 0.0 |
| 6 | 16.6 | 5.3 | 28.0 | 37.9 | 12.2 | 0.0 |
| 9 | 17.2 | 4.8 | 18.8 | 39.1 | 20.2 | 0.0 |
| 11 | 18.3 | 5.2 | 19.6 | 38.3 | 18.5 | 0.0 |
| 12 | 18.2 | 5.6 | 20.6 | 37.0 | 18.6 | 0.0 |
| 13 | 15.4 | 5.3 | 25.9 | 38.7 | 14.7 | 0.0 |
| 18 | 16.4 | 5.5 | 23.2 | 40.7 | 14.1 | 0.0 |
| 28 | 16.7 | 4.7 | 22.5 | 39.6 | 16.4 | 0.0 |
| 29 | 16.6 | 4.6 | 17.7 | 43.0 | 18.1 | 0.0 |
| Avg. ** | 11.8 | 3.5 | 45.8 | 25.7 | 6.2 | 7.0 |

TABLE 22

Fatty Acid Analysis from Soy Somatic Embyros transformed with pKR1556 comprising McConj, McMBOAT and McDGAT2 (MSE2592)
MSE2592 (McConj, McMBOAT, McDGAT2)

| Event # | 16:0 | 18:0 | 18:1 | 18:2 | 18:3 | Eleo |
|---|---|---|---|---|---|---|
| 29 | 8.9 | 3.9 | 38.3 | 24.6 | 6.2 | 18.1 |
| 28 | 10.1 | 4.8 | 43.8 | 22.8 | 4.8 | 13.7 |
| 30 | 9.1 | 3.4 | 46.8 | 23.0 | 4.6 | 13.1 |
| 25 | 11.5 | 4.5 | 35.2 | 29.8 | 6.8 | 12.3 |
| 9 | 12.2 | 4.7 | 26.1 | 35.4 | 10.9 | 10.7 |
| 7 | 10.9 | 4.1 | 46.1 | 24.0 | 4.9 | 10.0 |
| 32 | 11.7 | 3.7 | 32.8 | 34.6 | 7.2 | 9.9 |
| 22 | 10.9 | 4.5 | 42.1 | 27.7 | 5.7 | 9.2 |
| 5 | 10.2 | 3.6 | 48.3 | 24.8 | 4.3 | 8.8 |
| 2 | 10.6 | 4.5 | 41.2 | 28.5 | 6.7 | 8.4 |
| 21 | 12.2 | 4.1 | 39.7 | 27.6 | 8.2 | 8.2 |
| 11 | 13.1 | 6.5 | 25.7 | 36.5 | 12.6 | 5.7 |
| 15 | 13.9 | 3.9 | 31.0 | 34.6 | 10.9 | 5.6 |
| 10 | 13.9 | 5.1 | 25.5 | 37.6 | 12.8 | 5.1 |
| 20 | 13.8 | 6.9 | 27.0 | 35.9 | 11.7 | 4.6 |
| 14 | 13.1 | 6.5 | 27.8 | 36.6 | 11.5 | 4.5 |
| 27 | 13.9 | 5.7 | 22.6 | 38.5 | 15.8 | 3.5 |
| 6 | 14.1 | 5.4 | 24.3 | 45.8 | 7.7 | 2.6 |
| 19 | 14.0 | 6.7 | 26.3 | 39.5 | 11.1 | 2.5 |
| 1 | 14.8 | 6.4 | 22.7 | 39.1 | 15.2 | 1.9 |
| 3 | 14.4 | 6.2 | 20.3 | 41.5 | 15.7 | 1.9 |
| 26 | 14.5 | 6.5 | 26.0 | 39.5 | 11.6 | 1.8 |
| 23 | 15.3 | 6.3 | 20.1 | 40.6 | 15.9 | 1.8 |
| 13 | 15.2 | 5.7 | 18.9 | 45.4 | 13.2 | 1.5 |
| 18 | 14.5 | 8.6 | 25.6 | 41.4 | 9.3 | 0.6 |
| 24 | 14.5 | 7.3 | 26.8 | 39.2 | 11.9 | 0.3 |
| 4 | 15.0 | 8.2 | 30.4 | 36.3 | 10.1 | 0.0 |
| 8 | 18.2 | 4.8 | 9.1 | 44.8 | 23.2 | 0.0 |
| 12 | 15.0 | 7.7 | 18.0 | 45.3 | 14.1 | 0.0 |
| 16 | 16.1 | 6.6 | 15.7 | 44.2 | 17.3 | 0.0 |
| 17 | 16.2 | 6.8 | 15.3 | 45.4 | 16.4 | 0.0 |
| 31 | 15.9 | 6.8 | 15.5 | 42.9 | 19.0 | 0.0 |
| Avg. ** | 10.4 | 4.3 | 38.0 | 27.1 | 6.6 | 13.6 |

TABLE 23

Fatty Acid Analysis from Soy Somatic Embyros transformed with pKR1562 comprising McConj and McDGAT2 (MSE2593)

| Event # | 16:0 | 18:0 | 18:1 | 18:2 | 18:3 | Eleo |
|---|---|---|---|---|---|---|
| 13 | 11.8 | 2.9 | 39.3 | 25.9 | 8.2 | 10.2 |
| 21 | 12.2 | 3.3 | 40.6 | 29.7 | 7.1 | 7.1 |
| 5 | 11.0 | 4.4 | 40.3 | 31.1 | 5.9 | 6.8 |
| 14 | 13.0 | 4.3 | 33.2 | 33.0 | 9.2 | 6.3 |
| 24 | 11.7 | 4.3 | 40.2 | 28.3 | 8.9 | 6.0 |
| 10 | 11.8 | 4.5 | 41.0 | 30.5 | 5.9 | 5.7 |
| 16 | 12.1 | 4.0 | 44.8 | 27.1 | 6.8 | 5.2 |
| 27 | 14.1 | 4.6 | 34.9 | 31.8 | 9.6 | 5.0 |
| 9 | 14.2 | 4.9 | 28.9 | 33.6 | 13.9 | 4.4 |
| 19 | 12.5 | 4.8 | 34.5 | 35.3 | 8.5 | 4.4 |
| 20 | 14.1 | 4.3 | 34.8 | 32.4 | 10.1 | 4.3 |
| 8 | 14.0 | 4.2 | 33.4 | 33.6 | 10.6 | 4.2 |
| 6 | 14.2 | 4.4 | 37.9 | 30.1 | 9.3 | 4.1 |
| 26 | 13.4 | 4.9 | 40.6 | 28.8 | 8.2 | 4.1 |
| 12 | 12.1 | 4.2 | 44.8 | 29.1 | 5.7 | 4.1 |
| 22 | 15.4 | 5.3 | 29.9 | 35.3 | 10.2 | 3.9 |
| 23 | 13.8 | 4.9 | 34.1 | 33.0 | 10.3 | 3.8 |
| 11 | 14.4 | 4.7 | 32.9 | 32.1 | 12.3 | 3.6 |
| 3 | 14.6 | 5.1 | 33.2 | 33.2 | 10.4 | 3.4 |
| 30 | 14.0 | 4.6 | 22.8 | 40.0 | 15.7 | 2.8 |
| 29 | 15.6 | 6.3 | 22.2 | 37.8 | 16.0 | 2.1 |
| 28 | 14.8 | 5.7 | 33.0 | 32.3 | 12.3 | 1.9 |
| 2 | 16.9 | 4.2 | 20.1 | 41.2 | 16.6 | 1.1 |
| 1 | 16.5 | 6.3 | 16.1 | 44.4 | 16.0 | 0.6 |
| 17 | 16.8 | 4.7 | 19.9 | 40.8 | 17.2 | 0.5 |
| 4 | 18.4 | 4.9 | 14.7 | 39.9 | 22.2 | 0.0 |
| 7 | 17.9 | 4.6 | 16.6 | 42.0 | 18.9 | 0.0 |
| 15 | 18.1 | 4.4 | 17.0 | 39.6 | 21.0 | 0.0 |
| 18 | 16.8 | 6.1 | 16.8 | 40.1 | 20.1 | 0.0 |
| 25 | 18.4 | 6.2 | 12.7 | 42.3 | 20.3 | 0.0 |
| Avg.** | 11.9 | 3.8 | 38.7 | 29.6 | 7.8 | 7.3 |

A summary of the average fatty acid profiles for the five events having highest ELEO content from each experiment (Avg. **) is shown in TABLE 24. In TABLE 24, the calculated % conjugation conversion efficiency (% Conj) to Eleostearic acid (ELEO) is also shown for the average of the five events having highest ELEO content from each experiment where the % Conj was calculated by dividing the sum of the average weight percent (wt. %) for ELEO by the sum of the average wt. % for 18:2 and ELEO and multiplying by 100 to express as a %. Also shown in TABLE 24 is the relative % desaturation (Rel % Conj) for each experiment where the % Conj for the experiment is divided by the % Conj for that of MSE2594 (McConj).

TABLE 24

Comparing average fatty acid profiles for MBOAT and/or DGAT2 co-expressed with a Momordica conjugase in Soy Somatic Embryos

| Experiment | 16:0 | 18:0 | 18:1 | 18:2 | 18:3 | Eleo | % Conj | Rel % Conj |
|---|---|---|---|---|---|---|---|---|
| MSE2594 (McConj) | 13.7 | 3.9 | 33.1 | 34.3 | 10.3 | 4.8 | 12.6 | 1.00 |

TABLE 24-continued

Comparing average fatty acid profiles for MBOAT and/or DGAT2 co-expressed with a Momordica conjugase in Soy Somatic Embryos

| Experiment | 16:0 | 18:0 | 18:1 | 18:2 | 18:3 | Eleo | % Conj | Rel % Conj |
|---|---|---|---|---|---|---|---|---|
| MSE2591 (McConj, McMBOAT) | 11.8 | 3.5 | 45.8 | 25.7 | 6.2 | 7.0 | 21.3 | 1.70 |
| MSE2592 (McConj, McMBOAT, McDGAT2) | 10.4 | 4.3 | 38.0 | 27.1 | 6.6 | 13.6 | 33.7 | 2.69 |
| MSE2593 (McConj, McDGAT2) | 11.9 | 3.8 | 38.7 | 29.6 | 7.8 | 7.3 | 19.8 | 1.57 |

TABLEs 20-24 demonstrate that co-expression of McMBOAT and/or McDGAT2 with McConj increases % Conj activity which leads to higher concentrations of ELEO in soy somatic embryos. McMBOAT and McDGAT2 co-expressed with McConj gives higher concentrations of ELEO than either McMBOAT or McDGAT2 co-expressed with McConj individually.

Example 14

Co-Expressing CoConj with CoMBOAT or CoMBOAT and CoDGAT2 in Soy Somatic Embryos Soybean expression vectors pKR1487 (SEQ ID NO:42), comprising CoConj and called experiment MSE2542, pKR1492 (SEQ ID NO:49), comprising CoConj and CoMBOAT and called experiment MSE2543 and pKR1498 (SEQ ID NO:50), comprising CoConj, CoMBOAT and CoDGAT2 and called experiment MSE2545 were transformed into soy, somatic embryos were harvested and lipid fatty acid profiles were analyzed exactly as described in Example 13, and results are summarized in TABLEs 25, 26, and 27, respectively.

In the Tables, the fatty acid profiles as a weight percent of total fatty acids are shown where 16:0 is palmitic acid, 18:0 is stearic acid, 18:1 is oleic acid, 18:2 is linoleic acid, 18:3 is alpha-linolenic acid and CAL is calendic acid. Results for each event are sorted according to CAL concentrations in decreasing order. The average fatty acid profiles for the five events having highest CAL content from each experiment are also shown in each table (Avg. **) where only events having calendic acid greater than 1% are included in the average calculation.

TABLE 25

Fatty Acid Analysis from Soy Somatic Embyros transformed with pKR1487 comprising CoConj (MSE2542)

| Event # | 16:0 | 18:0 | 18:1 | 18:2 | 18:3 | CAL |
|---|---|---|---|---|---|---|
| 23 | 14.6 | 5.1 | 21.9 | 38.1 | 17.1 | 3.2 |
| 10 | 18.3 | 5.5 | 17.5 | 37.9 | 19.4 | 1.5 |
| 3 | 17.1 | 6.2 | 21.5 | 37.1 | 17.2 | 1.0 |
| 13 | 17.5 | 5.6 | 19.3 | 36.7 | 20.4 | 0.6 |
| 11 | 16.2 | 4.1 | 17.8 | 40.6 | 20.9 | 0.5 |
| 1 | 17.5 | 4.9 | 17.6 | 38.3 | 21.8 | 0.0 |
| 2 | 17.6 | 5.4 | 21.5 | 37.6 | 17.9 | 0.0 |
| 4 | 17.4 | 4.6 | 16.5 | 39.6 | 21.9 | 0.0 |
| 5 | 17.1 | 5.3 | 18.2 | 38.9 | 20.5 | 0.0 |
| 6 | 17.4 | 5.4 | 18.6 | 37.3 | 21.2 | 0.0 |
| 7 | 16.9 | 4.9 | 17.5 | 40.1 | 20.6 | 0.0 |
| 8 | 17.1 | 5.2 | 15.5 | 39.0 | 23.1 | 0.0 |
| 9 | 17.1 | 5.5 | 20.8 | 37.9 | 18.7 | 0.0 |
| 12 | 17.8 | 4.9 | 15.0 | 39.5 | 22.8 | 0.0 |
| 14 | 16.8 | 5.2 | 17.8 | 40.1 | 20.0 | 0.0 |
| 15 | 17.2 | 5.0 | 18.9 | 39.5 | 19.3 | 0.0 |
| 16 | 17.1 | 5.9 | 17.7 | 37.9 | 21.4 | 0.0 |
| 17 | 17.1 | 4.7 | 15.6 | 40.3 | 22.3 | 0.0 |
| 18 | 18.5 | 4.7 | 13.5 | 38.3 | 25.0 | 0.0 |
| 19 | 15.7 | 5.3 | 17.4 | 45.7 | 15.9 | 0.0 |
| 20 | 17.4 | 5.3 | 18.9 | 39.9 | 18.4 | 0.0 |
| 22 | 17.2 | 5.2 | 18.4 | 39.0 | 20.2 | 0.0 |
| 24 | 16.9 | 5.0 | 16.1 | 40.4 | 21.6 | 0.0 |
| 26 | 17.4 | 4.6 | 12.3 | 41.8 | 23.9 | 0.0 |
| 27 | 17.6 | 5.5 | 20.3 | 37.6 | 19.0 | 0.0 |
| 28 | 16.9 | 4.8 | 17.9 | 40.5 | 19.9 | 0.0 |
| 30 | 16.8 | 5.7 | 17.5 | 39.7 | 20.2 | 0.0 |
| 31 | 16.8 | 5.3 | 17.9 | 38.9 | 21.1 | 0.0 |
| Avg.** | 16.7 | 5.3 | 19.6 | 38.1 | 19.0 | 1.3 |

TABLE 26

Fatty Acid Analysis from Soy Somatic Embyros transformed with pKR1492 comprising CoConj and CoMBOAT (MSE2543)

| Event # | 16:0 | 18:0 | 18:1 | 18:2 | 18:3 | CAL |
|---|---|---|---|---|---|---|
| 4 | 15.2 | 5.2 | 17.4 | 36.4 | 20.3 | 5.5 |
| 10 | 14.9 | 5.4 | 22.7 | 35.5 | 16.7 | 4.8 |
| 1 | 15.2 | 4.9 | 19.7 | 35.5 | 20.0 | 4.7 |
| 2 | 14.0 | 6.5 | 23.0 | 36.2 | 16.1 | 4.2 |
| 11 | 13.6 | 5.8 | 28.2 | 33.0 | 16.0 | 3.4 |
| 17 | 15.4 | 5.3 | 24.6 | 35.7 | 15.7 | 3.4 |
| 29 | 13.4 | 6.3 | 23.2 | 42.7 | 12.1 | 2.3 |
| 3 | 15.3 | 6.5 | 22.6 | 36.8 | 16.4 | 2.2 |
| 8 | 15.7 | 5.4 | 22.0 | 36.4 | 18.2 | 2.2 |
| 26 | 14.5 | 5.8 | 23.6 | 39.0 | 15.2 | 2.0 |
| 19 | 16.2 | 6.2 | 21.8 | 38.5 | 15.5 | 1.8 |
| 20 | 14.8 | 6.3 | 26.2 | 35.7 | 15.3 | 1.8 |
| 30 | 15.8 | 6.5 | 22.8 | 39.1 | 14.4 | 1.5 |
| 6 | 16.5 | 5.0 | 19.0 | 39.2 | 19.6 | 0.7 |
| 22 | 17.2 | 6.1 | 21.5 | 38.6 | 16.1 | 0.5 |
| 13 | 16.3 | 4.8 | 18.4 | 38.7 | 21.3 | 0.4 |
| 7 | 15.8 | 7.8 | 18.5 | 41.7 | 15.7 | 0.4 |
| 5 | 19.3 | 5.4 | 14.5 | 40.6 | 20.2 | 0.0 |
| 9 | 17.6 | 5.5 | 18.3 | 40.7 | 18.0 | 0.0 |
| 12 | 17.1 | 6.0 | 21.3 | 39.2 | 16.4 | 0.0 |
| 14 | 16.9 | 5.5 | 23.7 | 38.2 | 15.7 | 0.0 |
| 15 | 17.4 | 5.8 | 20.3 | 37.6 | 18.9 | 0.0 |
| 16 | 17.2 | 5.9 | 20.2 | 40.7 | 15.9 | 0.0 |
| 18 | 17.1 | 5.5 | 21.0 | 38.5 | 17.9 | 0.0 |
| 21 | 16.9 | 6.2 | 22.1 | 38.4 | 16.3 | 0.0 |
| 23 | 17.3 | 6.3 | 22.4 | 36.2 | 17.8 | 0.0 |
| 24 | 18.2 | 6.3 | 18.6 | 39.4 | 17.6 | 0.0 |
| 25 | 17.3 | 5.7 | 20.1 | 38.4 | 18.5 | 0.0 |
| 27 | 17.1 | 5.7 | 21.4 | 38.1 | 17.7 | 0.0 |
| 28 | 16.8 | 7.7 | 25.2 | 35.1 | 15.1 | 0.0 |
| Avg.** | 14.6 | 5.6 | 22.2 | 35.3 | 17.8 | 4.5 |

TABLE 27

Fatty Acid Analysis from Soy Somatic Embyros transformed with pKR1498 comprising CoConj, CoMBOAT and CoDGAT2 (MSE2545)

| Event # | 16:0 | 18:0 | 18:1 | 18:2 | 18:3 | CAL |
|---|---|---|---|---|---|---|
| 25 | 13.4 | 6.3 | 24.0 | 32.1 | 16.8 | 7.4 |
| 4 | 13.6 | 5.9 | 25.0 | 31.6 | 17.3 | 6.6 |
| 2 | 13.9 | 5.6 | 18.1 | 42.9 | 13.4 | 6.0 |

TABLE 27-continued

Fatty Acid Analysis from Soy Somatic Embyros transformed with pKR1498 comprising CoConj, CoMBOAT and CoDGAT2 (MSE2545)

| Event # | 16:0 | 18:0 | 18:1 | 18:2 | 18:3 | CAL |
|---|---|---|---|---|---|---|
| 16 | 13.5 | 5.7 | 23.3 | 36.0 | 16.0 | 5.4 |
| 21 | 14.9 | 5.7 | 24.3 | 34.5 | 16.8 | 3.8 |
| 14 | 15.6 | 4.7 | 16.6 | 38.1 | 22.5 | 2.4 |
| 29 | 16.3 | 6.1 | 22.2 | 35.1 | 18.0 | 2.3 |
| 30 | 15.8 | 7.3 | 18.4 | 41.1 | 16.0 | 1.4 |
| 8 | 15.5 | 7.2 | 19.0 | 41.3 | 15.9 | 1.1 |
| 13 | 15.6 | 5.5 | 21.6 | 38.2 | 18.2 | 0.9 |
| 15 | 15.6 | 6.6 | 23.5 | 35.3 | 18.0 | 0.9 |
| 23 | 16.3 | 5.0 | 18.6 | 40.0 | 19.4 | 0.7 |
| 5 | 16.4 | 5.0 | 17.8 | 39.9 | 20.1 | 0.7 |
| 17 | 16.8 | 5.6 | 18.7 | 36.8 | 21.5 | 0.6 |
| 22 | 16.6 | 5.0 | 17.6 | 38.4 | 21.9 | 0.6 |
| 11 | 16.7 | 6.1 | 22.5 | 37.4 | 17.1 | 0.4 |
| 10 | 15.4 | 6.2 | 24.6 | 37.0 | 16.5 | 0.4 |
| 28 | 16.8 | 6.0 | 20.3 | 39.7 | 17.0 | 0.3 |
| 24 | 15.9 | 6.0 | 22.8 | 38.2 | 16.8 | 0.2 |
| 1 | 16.2 | 5.5 | 18.2 | 37.5 | 22.7 | 0.0 |
| 3 | 16.9 | 6.3 | 20.3 | 39.5 | 17.0 | 0.0 |
| 6 | 16.1 | 5.9 | 21.3 | 38.5 | 18.2 | 0.0 |
| 7 | 16.0 | 7.2 | 25.1 | 36.3 | 15.3 | 0.0 |
| 9 | 15.8 | 6.5 | 24.2 | 38.3 | 15.2 | 0.0 |
| 12 | 17.0 | 5.4 | 19.6 | 39.6 | 18.5 | 0.0 |
| 18 | 16.9 | 4.9 | 18.2 | 38.7 | 21.4 | 0.0 |
| 19 | 16.3 | 6.4 | 24.9 | 36.5 | 16.0 | 0.0 |
| 20 | 16.1 | 6.7 | 24.9 | 37.7 | 14.5 | 0.0 |
| 26 | 16.4 | 5.0 | 20.0 | 39.0 | 19.6 | 0.0 |
| 27 | 17.5 | 6.4 | 22.1 | 37.1 | 16.9 | 0.0 |
| 31 | 17.7 | 6.0 | 18.7 | 36.5 | 21.1 | 0.0 |
| Avg.** | 13.8 | 5.9 | 23.0 | 35.4 | 16.1 | 5.8 |

A summary of the average fatty acid profiles for the five events having highest CAL content from each experiment (Avg. **) is shown in TABLE 28. In TABLE 28, the calculated % conjugation conversion efficiency (% Conj) to Calendic acid (CAL) is also shown for the average of the five events having highest CAL content from each experiment where the % Conj was calculated by dividing the sum of the average weight percent (wt. %) for CAL by the sum of the average wt. % for 18:2 and CAL and multiplying by 100 to express as a %. Also shown in TABLE 28 is the relative % desaturation (Rel % Conj) for each experiment where the % Conj for the experiment is divided by the % Conj for that of MSE2542 (CoConj).

TABLE 28

Comparing average fatty acid profiles for MBOATs co-expressed with a *Calendula* conjugase in Soy Somatic Embryos

| Experiment | 16:0 | 18:0 | 18:1 | 18:2 | 18:3 | Cal | % Conj | Rel % Conj |
|---|---|---|---|---|---|---|---|---|
| MSE2542 (CoConj) | 16.7 | 5.3 | 19.6 | 38.1 | 19.0 | 1.3 | 3.3 | 1.00 |
| MSE2543 (CoConj, CoMBOAT) | 14.6 | 5.6 | 22.2 | 35.3 | 17.8 | 4.5 | 11.3 | 3.37 |
| MSE2544 (CoConj, CoMBOAT, CoDGAT2) | 13.8 | 5.9 | 23.0 | 35.4 | 16.1 | 5.8 | 14.3 | 4.25 |

TABLEs 25-28 demonstrate that co-expression of CoMBOAT or CoMBOAT and CoDGAT2 with CoConj gives higher % Conj activity which leads to higher concentrations of CAL in soy somatic embryos. CoMBOAT and CoDGAT2 co-expressed with CoConj gives higher concentrations of CAL than CoMBOAT co-expressed with CoConj individually. Results were not obtained for CoDGAT2 co-expressed individually with CoConj due to contamination of the experiment.

Example 15

Co-Expressing MaD6Des and MaElo (Delta-6 Desaturase Pathway) with Either CoMBOAT or McMBOAT in Soy Somatic Embryos Soybean expression vectors pKR1561 (SEQ ID NO:60), comprising MaD6Des and MaElo and called experiments MSE2597, pKR1549 (SEQ ID NO:62), comprising MaD6Des, MaElo and McMBOAT and called experiment MSE2595 and pKR1557 (SEQ ID NO:64), comprising MaD6Des, MaElo and CoMBOAT and called experiment MSE2596 were transformed into soy, somatic embryos were harvested and lipid fatty acid profiles were analyzed exactly as described in Example 13 and results are summarized in TABLEs 29, 30 and 31, respectively.

In the Tables, the fatty acid profiles as a weight percent of total fatty acids are shown where 16:0 is palmitic acid, 18:0 is stearic acid, 18:1 is oleic acid, 18:2 is linoleic acid, GLA is gamma-linolenic acid, 18:3 is alpha-linolenic acid, STA is stearidonic acid, DGLA is dihomo-gamma-linolenic acid and ETA is eicosatetraenoic acid [20:1($\Delta$8,11,14,17)]. The sum of GLA+STA and DGLA+ETA is also shown. Results for each event are sorted according to DGLA+ETA concentrations in decreasing order. The average fatty acid profiles for the five events having highest DGLA+ETA content from each experiment are also shown in each table (Avg. **).

TABLE 29

Fatty Acid Analysis from Soy Somatic Embyros transformed with pKR1561 comprising MaD6Des and MaElo (MSE2597)

| Event # | 16:0 | 18:0 | 18:1 | 18:2 | GLA | 18:3 | STA | EDA | DGLA | ERA | ETA | GLA + STA | EDA + ERA | DGLA + ETA |
|---|---|---|---|---|---|---|---|---|---|---|---|---|---|---|
| 10 | 15.2 | 7.3 | 16.5 | 14.9 | 18.0 | 8.7 | 2.5 | 1.8 | 12.1 | 1.1 | 1.7 | 20.5 | 3.0 | 13.8 |
| 22 | 16.1 | 6.0 | 23.0 | 6.8 | 25.8 | 4.6 | 3.0 | 0.6 | 12.5 | 0.1 | 1.6 | 28.8 | 0.7 | 14.1 |
| 20 | 13.8 | 7.4 | 21.1 | 13.3 | 21.5 | 6.8 | 2.0 | 1.1 | 11.3 | 0.6 | 1.1 | 23.5 | 1.7 | 12.4 |
| 1 | 13.6 | 7.4 | 25.8 | 9.1 | 22.6 | 5.0 | 2.6 | 1.3 | 10.9 | 0.5 | 1.4 | 25.1 | 1.8 | 12.3 |
| 29 | 13.8 | 7.1 | 23.0 | 15.3 | 18.5 | 7.3 | 1.8 | 1.2 | 10.3 | 0.6 | 1.1 | 20.3 | 1.8 | 11.4 |
| 24 | 14.3 | 6.5 | 21.0 | 12.5 | 22.8 | 7.6 | 2.7 | 1.0 | 9.7 | 0.5 | 1.4 | 25.5 | 1.6 | 11.1 |
| 14 | 13.9 | 6.6 | 22.5 | 16.6 | 21.0 | 6.0 | 1.6 | 1.0 | 9.6 | 0.4 | 0.9 | 22.5 | 1.4 | 10.4 |
| 16 | 14.1 | 7.0 | 27.7 | 11.8 | 19.7 | 6.3 | 2.2 | 0.8 | 8.9 | 0.3 | 1.2 | 21.9 | 1.1 | 10.1 |
| 13 | 15.3 | 6.9 | 22.4 | 15.3 | 17.6 | 8.2 | 2.1 | 1.8 | 8.4 | 0.8 | 1.1 | 19.7 | 2.6 | 9.5 |
| 28 | 14.4 | 6.3 | 24.7 | 19.8 | 13.9 | 9.2 | 1.5 | 1.0 | 7.8 | 0.5 | 0.8 | 15.4 | 1.5 | 8.6 |
| 23 | 16.2 | 5.5 | 22.5 | 12.1 | 27.0 | 6.4 | 3.2 | 0.4 | 5.8 | 0.0 | 0.8 | 30.2 | 0.5 | 6.6 |

TABLE 29-continued

Fatty Acid Analysis from Soy Somatic Embyros transformed with pKR1561 comprising MaD6Des and MaElo (MSE2597)

| Event # | 16:0 | 18:0 | 18:1 | 18:2 | GLA | 18:3 | STA | EDA | DGLA | ERA | ETA | GLA + STA | EDA + ERA | DGLA + ETA |
|---|---|---|---|---|---|---|---|---|---|---|---|---|---|---|
| 8 | 15.6 | 5.9 | 19.2 | 15.6 | 24.0 | 9.5 | 3.3 | 0.4 | 5.6 | 0.1 | 0.8 | 27.3 | 0.5 | 6.4 |
| 21 | 14.6 | 5.3 | 23.3 | 26.6 | 11.7 | 10.4 | 1.2 | 0.8 | 5.2 | 0.4 | 0.5 | 12.9 | 1.2 | 5.7 |
| 6 | 16.0 | 6.0 | 17.3 | 32.5 | 7.8 | 11.8 | 1.0 | 2.1 | 4.2 | 0.7 | 0.4 | 8.8 | 2.9 | 4.6 |
| 2 | 17.8 | 5.8 | 17.3 | 38.0 | 0.4 | 19.7 | 0.5 | 0.0 | 0.6 | 0.0 | 0.0 | 0.9 | 0.0 | 0.6 |
| 25 | 18.5 | 5.3 | 15.9 | 39.4 | 1.9 | 17.9 | 0.6 | 0.3 | 0.3 | 0.0 | 0.0 | 2.5 | 0.3 | 0.3 |
| 15 | 18.3 | 4.6 | 11.0 | 42.6 | 1.1 | 21.5 | 0.7 | 0.0 | 0.3 | 0.0 | 0.0 | 1.8 | 0.0 | 0.3 |
| 3 | 18.9 | 4.2 | 12.3 | 40.5 | 1.8 | 21.2 | 0.7 | 0.1 | 0.3 | 0.0 | 0.0 | 2.5 | 0.1 | 0.3 |
| 27 | 14.8 | 6.6 | 20.2 | 33.3 | 9.8 | 10.6 | 1.0 | 2.7 | 0.3 | 0.8 | 0.0 | 10.8 | 3.4 | 0.3 |
| 17 | 16.1 | 6.0 | 19.3 | 38.8 | 0.8 | 15.1 | 0.5 | 2.3 | 0.3 | 0.8 | 0.0 | 1.3 | 3.0 | 0.3 |
| 5 | 18.8 | 5.1 | 12.7 | 40.3 | 0.9 | 21.3 | 0.6 | 0.1 | 0.2 | 0.0 | 0.0 | 1.5 | 0.1 | 0.2 |
| 4 | 16.5 | 5.8 | 16.4 | 39.8 | 0.2 | 15.4 | 0.4 | 3.9 | 0.2 | 1.4 | 0.0 | 0.6 | 5.4 | 0.2 |
| 12 | 19.1 | 5.3 | 15.0 | 40.6 | 0.4 | 18.8 | 0.5 | 0.0 | 0.2 | 0.0 | 0.0 | 0.9 | 0.0 | 0.2 |
| 11 | 17.9 | 5.1 | 15.3 | 41.2 | 0.2 | 19.4 | 0.6 | 0.2 | 0.1 | 0.0 | 0.0 | 0.8 | 0.2 | 0.1 |
| 7 | 17.1 | 5.0 | 18.7 | 39.8 | 0.3 | 17.3 | 0.5 | 0.7 | 0.1 | 0.5 | 0.0 | 0.8 | 1.2 | 0.1 |
| 30 | 16.5 | 5.6 | 13.8 | 42.2 | 0.2 | 16.8 | 0.4 | 3.3 | 0.1 | 1.2 | 0.0 | 0.6 | 4.5 | 0.1 |
| 9 | 14.4 | 7.2 | 15.0 | 37.4 | 0.2 | 13.6 | 0.4 | 8.6 | 0.0 | 3.2 | 0.0 | 0.6 | 11.8 | 0.0 |
| 18 | 17.2 | 5.8 | 19.9 | 38.8 | 0.1 | 17.7 | 0.4 | 0.0 | 0.0 | 0.0 | 0.0 | 0.5 | 0.0 | 0.0 |
| 19 | 14.1 | 7.5 | 18.4 | 38.4 | 0.0 | 12.4 | 0.4 | 6.8 | 0.0 | 2.1 | 0.0 | 0.4 | 8.8 | 0.0 |
| 26 | 14.7 | 4.5 | 17.2 | 18.7 | 33.2 | 8.1 | 3.3 | 0.3 | 0.0 | 0.0 | 0.0 | 36.5 | 0.3 | 0.0 |
| Avg.** | 14.5 | 7.0 | 21.9 | 11.9 | 21.2 | 6.5 | 2.4 | 1.2 | 11.4 | 0.6 | 1.4 | 23.6 | 1.8 | 12.8 |

TABLE 30

Fatty Acid Analysis from Soy Somatic Embyros transformed with pKR1549 comprising MaD6Des, MaElo and McMBOAT (MSE2595)

| Event # | 16:0 | 18:0 | 18:1 | 18:2 | GLA | 18:3 | STA | EDA | DGLA | ERA | ETA | GLA + STA | EDA + ERA | DGLA + ETA |
|---|---|---|---|---|---|---|---|---|---|---|---|---|---|---|
| 19 | 14.7 | 6.5 | 16.4 | 15.5 | 18.2 | 7.6 | 1.8 | 1.4 | 15.8 | 0.6 | 1.5 | 20.0 | 2.1 | 17.2 |
| 26 | 13.9 | 7.4 | 18.8 | 12.7 | 18.9 | 6.1 | 2.0 | 1.9 | 15.6 | 1.1 | 1.7 | 20.9 | 3.0 | 17.3 |
| 4 | 15.1 | 8.5 | 14.6 | 13.4 | 20.8 | 8.1 | 2.3 | 0.9 | 14.1 | 0.4 | 1.8 | 23.2 | 1.3 | 15.9 |
| 30 | 16.2 | 8.4 | 18.3 | 13.2 | 16.9 | 6.5 | 2.3 | 1.5 | 14.0 | 0.9 | 1.8 | 19.2 | 2.4 | 15.9 |
| 12 | 14.4 | 5.7 | 19.2 | 12.2 | 26.4 | 5.7 | 2.4 | 1.0 | 11.3 | 0.4 | 1.3 | 28.8 | 1.4 | 12.6 |
| 8 | 15.4 | 6.0 | 24.1 | 8.2 | 25.2 | 6.2 | 3.1 | 0.9 | 10.0 | 0.5 | 1.4 | 28.3 | 1.4 | 11.3 |
| 15 | 15.5 | 7.0 | 16.1 | 24.6 | 11.1 | 11.6 | 1.3 | 2.0 | 8.9 | 1.0 | 0.9 | 12.4 | 3.1 | 9.8 |
| 23 | 14.9 | 6.2 | 21.7 | 20.3 | 17.2 | 9.0 | 2.1 | 0.2 | 7.6 | 0.1 | 0.8 | 19.2 | 0.3 | 8.4 |
| 5 | 15.1 | 7.1 | 21.2 | 21.2 | 15.4 | 9.0 | 1.5 | 0.8 | 7.6 | 0.4 | 0.7 | 16.9 | 1.2 | 8.2 |
| 16 | 15.9 | 8.4 | 14.1 | 27.2 | 9.9 | 11.4 | 1.2 | 3.7 | 5.7 | 1.7 | 0.7 | 11.1 | 5.4 | 6.4 |
| 20 | 16.2 | 8.2 | 22.9 | 25.1 | 5.3 | 12.9 | 1.1 | 1.8 | 4.9 | 1.0 | 0.6 | 6.4 | 2.8 | 5.5 |
| 2 | 16.9 | 5.1 | 16.8 | 31.2 | 13.7 | 12.7 | 1.7 | 0.4 | 1.3 | 0.0 | 0.2 | 15.4 | 0.4 | 1.5 |
| 28 | 14.5 | 6.4 | 11.7 | 36.1 | 1.2 | 15.5 | 0.7 | 9.4 | 1.4 | 3.1 | 0.0 | 1.9 | 12.4 | 1.4 |
| 3 | 13.9 | 7.8 | 15.7 | 34.8 | 0.8 | 13.2 | 0.4 | 9.2 | 0.7 | 3.4 | 0.0 | 1.3 | 12.6 | 0.7 |
| 14 | 16.2 | 8.6 | 16.5 | 38.4 | 0.3 | 14.2 | 0.4 | 3.5 | 0.6 | 1.2 | 0.0 | 0.7 | 4.8 | 0.6 |
| 22 | 18.0 | 5.2 | 15.9 | 41.0 | 0.5 | 17.9 | 0.7 | 0.3 | 0.5 | 0.0 | 0.0 | 1.2 | 0.3 | 0.5 |
| 21 | 16.1 | 7.9 | 15.6 | 40.1 | 1.0 | 16.0 | 0.4 | 1.7 | 0.4 | 0.7 | 0.1 | 1.4 | 2.3 | 0.5 |
| 17 | 14.4 | 7.5 | 17.2 | 37.7 | 0.8 | 12.0 | 0.4 | 7.2 | 0.5 | 2.3 | 0.0 | 1.2 | 9.4 | 0.5 |
| 1 | 18.0 | 4.9 | 14.9 | 40.3 | 0.3 | 20.7 | 0.5 | 0.0 | 0.4 | 0.0 | 0.0 | 0.8 | 0.0 | 0.4 |
| 9 | 16.5 | 6.5 | 21.2 | 38.0 | 0.2 | 16.7 | 0.4 | 0.1 | 0.3 | 0.0 | 0.0 | 0.6 | 0.1 | 0.3 |
| 11 | 16.4 | 6.0 | 15.2 | 44.1 | 0.1 | 17.4 | 0.4 | 0.0 | 0.3 | 0.0 | 0.0 | 0.4 | 0.0 | 0.3 |
| 29 | 17.2 | 6.3 | 14.2 | 40.7 | 3.1 | 17.3 | 0.8 | 0.1 | 0.3 | 0.0 | 0.0 | 3.8 | 0.2 | 0.3 |
| 18 | 17.7 | 4.5 | 13.0 | 44.9 | 0.3 | 18.4 | 0.7 | 0.2 | 0.3 | 0.0 | 0.0 | 0.9 | 0.2 | 0.3 |
| 6 | 16.4 | 7.0 | 14.6 | 40.7 | 0.3 | 18.3 | 0.4 | 2.1 | 0.2 | 0.0 | 0.1 | 0.7 | 2.1 | 0.3 |
| 25 | 16.5 | 8.1 | 14.9 | 39.3 | 0.2 | 17.8 | 0.4 | 1.7 | 0.2 | 1.0 | 0.0 | 0.6 | 2.6 | 0.2 |
| 27 | 17.1 | 6.7 | 22.7 | 36.8 | 0.6 | 15.3 | 0.4 | 0.0 | 0.2 | 0.0 | 0.0 | 1.1 | 0.0 | 0.2 |
| 13 | 16.8 | 9.4 | 18.7 | 39.6 | 0.0 | 15.0 | 0.3 | 0.0 | 0.2 | 0.0 | 0.0 | 0.3 | 0.0 | 0.2 |
| 10 | 17.0 | 6.1 | 21.7 | 38.6 | 0.2 | 15.7 | 0.4 | 0.1 | 0.2 | 0.0 | 0.0 | 0.6 | 0.1 | 0.2 |
| 24 | 17.3 | 7.2 | 22.8 | 36.6 | 0.1 | 15.4 | 0.4 | 0.1 | 0.1 | 0.0 | 0.0 | 0.5 | 0.1 | 0.1 |
| 7 | 16.5 | 5.8 | 14.4 | 46.3 | 0.0 | 16.1 | 0.3 | 0.5 | 0.0 | 0.0 | 0.0 | 0.4 | 0.5 | 0.0 |
| Avg.** | 14.9 | 7.3 | 17.5 | 13.4 | 20.3 | 6.8 | 2.1 | 1.3 | 14.2 | 0.7 | 1.6 | 22.4 | 2.0 | 15.8 |

TABLE 31

Fatty Acid Analysis from Soy Somatic Embyros transformed with pKR1557 comprising MaD6Des, MaElo and CoMBOAT (MSE2596).

| Event # | 16:0 | 18:0 | 18:1 | 18:2 | GLA | 18:3 | STA | EDA | DGLA | ERA | ETA | GLA + STA | EDA + ERA | DGLA + ETA |
|---|---|---|---|---|---|---|---|---|---|---|---|---|---|---|
| 19 | 13.4 | 12.9 | 17.2 | 11.5 | 17.0 | 5.7 | 1.6 | 1.2 | 17.2 | 0.7 | 1.6 | 18.7 | 1.9 | 18.7 |
| 24 | 15.3 | 7.0 | 19.8 | 13.5 | 20.2 | 6.7 | 1.9 | 0.7 | 13.2 | 0.3 | 1.3 | 22.2 | 1.0 | 14.5 |
| 8 | 14.3 | 8.3 | 24.6 | 12.4 | 16.1 | 6.4 | 1.7 | 1.1 | 13.0 | 0.7 | 1.3 | 17.8 | 1.8 | 14.4 |
| 30 | 14.9 | 9.9 | 16.2 | 17.7 | 13.9 | 9.1 | 1.5 | 1.8 | 12.6 | 1.0 | 1.3 | 15.4 | 2.9 | 13.9 |
| 23 | 13.6 | 9.5 | 15.4 | 15.7 | 22.0 | 6.4 | 1.8 | 1.2 | 12.7 | 0.5 | 1.1 | 23.8 | 1.7 | 13.8 |
| 28 | 14.6 | 8.2 | 22.6 | 15.4 | 15.1 | 7.9 | 1.9 | 1.6 | 10.4 | 1.0 | 1.3 | 17.0 | 2.6 | 11.7 |
| 22 | 14.4 | 7.2 | 22.6 | 18.7 | 14.3 | 9.4 | 1.6 | 0.8 | 9.5 | 0.5 | 1.1 | 15.9 | 1.3 | 10.5 |
| 7 | 13.8 | 9.8 | 15.9 | 26.7 | 9.5 | 9.2 | 1.0 | 2.8 | 9.5 | 1.1 | 0.7 | 10.5 | 3.9 | 10.2 |
| 11 | 15.3 | 8.6 | 17.8 | 31.2 | 9.3 | 10.6 | 1.0 | 0.2 | 5.3 | 0.1 | 0.5 | 10.3 | 0.3 | 5.9 |
| 4 | 16.6 | 4.5 | 14.5 | 40.4 | 5.7 | 13.3 | 0.7 | 0.5 | 3.2 | 0.2 | 0.3 | 6.4 | 0.7 | 3.6 |
| 12 | 18.0 | 5.3 | 15.7 | 37.0 | 1.3 | 20.9 | 0.6 | 0.0 | 1.2 | 0.0 | 0.0 | 1.9 | 0.0 | 1.2 |
| 14 | 16.3 | 6.5 | 19.1 | 36.9 | 1.2 | 16.1 | 0.5 | 1.6 | 0.9 | 0.7 | 0.1 | 1.7 | 2.4 | 1.1 |
| 9 | 17.0 | 5.7 | 15.0 | 34.4 | 7.4 | 18.2 | 1.3 | 0.1 | 0.8 | 0.0 | 0.2 | 8.6 | 0.1 | 1.0 |
| 6 | 16.3 | 8.0 | 16.4 | 39.8 | 1.3 | 15.6 | 0.4 | 0.7 | 0.9 | 0.4 | 0.1 | 1.7 | 1.1 | 1.0 |
| 16 | 16.9 | 6.5 | 13.7 | 38.4 | 4.5 | 18.5 | 0.8 | 0.0 | 0.7 | 0.0 | 0.0 | 5.3 | 0.0 | 0.7 |
| 29 | 16.3 | 5.5 | 13.1 | 37.9 | 0.6 | 20.8 | 0.6 | 2.8 | 0.6 | 1.8 | 0.1 | 1.1 | 4.6 | 0.7 |
| 2 | 14.9 | 7.2 | 17.7 | 44.4 | 0.5 | 14.3 | 0.3 | 0.0 | 0.6 | 0.0 | 0.1 | 0.8 | 0.0 | 0.7 |
| 10 | 14.7 | 7.5 | 17.6 | 44.8 | 0.2 | 14.4 | 0.3 | 0.1 | 0.5 | 0.0 | 0.0 | 0.4 | 0.1 | 0.5 |
| 25 | 17.1 | 6.1 | 19.3 | 36.0 | 1.6 | 16.5 | 0.5 | 1.7 | 0.4 | 1.0 | 0.0 | 2.0 | 2.6 | 0.4 |
| 5 | 14.7 | 7.9 | 14.4 | 25.6 | 26.5 | 8.3 | 2.2 | 0.1 | 0.3 | 0.0 | 0.0 | 28.7 | 0.1 | 0.4 |
| 17 | 18.1 | 5.0 | 13.5 | 27.6 | 18.8 | 14.0 | 2.6 | 0.1 | 0.3 | 0.0 | 0.0 | 21.4 | 0.1 | 0.3 |
| 20 | 18.0 | 5.9 | 19.3 | 40.0 | 0.3 | 15.8 | 0.5 | 0.0 | 0.2 | 0.0 | 0.0 | 0.8 | 0.0 | 0.2 |
| 18 | 17.3 | 7.3 | 16.8 | 43.1 | 0.2 | 14.8 | 0.3 | 0.1 | 0.2 | 0.0 | 0.0 | 0.5 | 0.1 | 0.2 |
| 3 | 15.1 | 6.9 | 15.1 | 38.6 | 0.1 | 15.0 | 0.5 | 6.3 | 0.2 | 2.3 | 0.0 | 0.6 | 8.6 | 0.2 |
| 13 | 17.1 | 6.9 | 14.6 | 41.5 | 0.3 | 19.0 | 0.4 | 0.1 | 0.2 | 0.0 | 0.0 | 0.6 | 0.1 | 0.2 |
| 27 | 17.4 | 5.6 | 12.3 | 31.4 | 14.7 | 15.6 | 2.3 | 0.5 | 0.2 | 0.0 | 0.0 | 17.0 | 0.5 | 0.2 |
| 1 | 17.5 | 5.4 | 19.9 | 38.4 | 0.5 | 17.8 | 0.5 | 0.0 | 0.0 | 0.0 | 0.0 | 1.0 | 0.0 | 0.0 |
| 15 | 18.9 | 4.8 | 12.0 | 41.3 | 0.1 | 22.3 | 0.6 | 0.0 | 0.0 | 0.0 | 0.0 | 0.7 | 0.0 | 0.0 |
| 21 | 17.2 | 5.2 | 16.1 | 40.9 | 3.2 | 16.7 | 0.7 | 0.0 | 0.0 | 0.0 | 0.0 | 3.8 | 0.0 | 0.0 |
| 26 | 15.4 | 6.7 | 26.0 | 37.8 | 0.6 | 13.1 | 0.3 | 0.0 | 0.0 | 0.0 | 0.0 | 1.0 | 0.0 | 0.0 |
| Avg.** | 14.3 | 9.5 | 18.6 | 14.2 | 17.8 | 6.9 | 1.7 | 1.2 | 13.7 | 0.6 | 1.3 | 19.6 | 1.9 | 15.1 |

A summary of the average fatty acid profiles for the five events having highest DGLA+ETA content from each experiment (Avg. **) is shown in TABLE 32. In TABLE 32, the calculated % delta-6 desaturation conversion efficiency (% D6) is also shown for the average of the five events having highest DGLA+ETA content from each experiment where the % D6 was calculated by dividing the sum of the average weight percent (wt. %) for GLA, STA, DGLA and ETA by the sum of the average wt. % for 18:2, 18:3, GLA, STA, DGLA and ETA and multiplying by 100 to express as a %. Similarly, the calculated % $C_{18}$ to $C_{20}$ elongation conversion efficiency (% Elo) is shown in TABLE 32 for the average of the five events having highest DGLA+ETA content from each experiment where the % Elo was calculated by dividing the sum of the average weight percent (wt. %) for DGLA and ETA by the sum of the average wt. % for GLA, STA, DGLA and ETA and multiplying by 100 to express as a %. Also shown in TABLE 32 is the relative % desaturation (Rel % D6) and relative % elongation (Rel % Elo) for each experiment where the % D6 or % Elo for the experiment is divided by the % D6 or % Elo for that of MSE2597 (MaD6,MaElo).

TABLE 32

Comparing average fatty acid profiles for MBOATs co-expressed with a delta-6 desaturase and Elongase (delta-6 desaturase PUFA pathway) in Soy Somatic Embryos

| Experiment | 16:0 | 18:0 | 18:1 | 18:2 | GLA | 18:3 | STA | EDA | DGLA | ERA | ETA |
|---|---|---|---|---|---|---|---|---|---|---|---|
| MSE2597 (MaD6Des, MaElo) | 14.5 | 7.0 | 21.9 | 11.9 | 21.2 | 6.5 | 2.4 | 1.2 | 11.4 | 0.6 | 1.4 |
| MSE2595 (MaD6Des, MaElo, McMBOAT) | 14.9 | 7.3 | 17.5 | 13.4 | 20.3 | 6.8 | 2.1 | 1.3 | 14.2 | 0.7 | 1.6 |
| MSE2596 (MaD6Des, MaElo, CoMBOAT) | 14.3 | 9.5 | 18.6 | 14.2 | 17.8 | 6.9 | 1.7 | 1.2 | 13.7 | 0.6 | 1.3 |

| Experiment | GLA + STA | EDA + ERA | DGLA + ETA | % D6 | % Elo | Rel % D6 | Rel % Elo |
|---|---|---|---|---|---|---|---|
| MSE2597 (MaD6Des, MaElo) | 23.6 | 1.8 | 12.8 | 66.7 | 35.3 | 1.00 | 1.00 |
| MSE2595 (MaD6Des, MaElo, McMBOAT) | 22.4 | 2.0 | 15.8 | 65.5 | 41.6 | 0.98 | 1.18 |

TABLE 32-continued

Comparing average fatty acid profiles for MBOATs co-expressed with a delta-6 desaturase and Elongase (delta-6 desaturase PUFA pathway) in Soy Somatic Embryos

| MSE2596 (MaD6Des, MaElo, CoMBOAT) | 19.6 | 1.9 | 15.1 | 62.2 | 43.7 | 0.93 | 1.24 |

TABLEs 29-32 demonstrate that co-expression of McMBOAT or CoMBOAT along with MaD6Des and MaElo leads to higher % Elo activity while % D6 activity is largely unaffected. Therefore, higher concentrations of DGLA+ETA are produced when either MBOAT is co-expressed with the MaD6Des and MaElo.

Example 16

Co-Expressing EgD9Elo and TpomD8Des (Delta-9 Elongase Pathway) with Either CoMBOAT or McMBOAT in Soy Somatic Embryos Soybean expression vectors pKR1560 (SEQ ID NO:65), comprising EgD9Elo and TpomD8Des and called experiment MSE2602, pKR1550 (SEQ ID NO:67), comprising EgD9Elo, TpomD8Des and McMBOAT and called experiment MSE2600 and pKR1558 (SEQ ID NO:69), comprising EgD9Elo, TpomD8Des and CoMBOAT and called experiment MSE2601 were transformed into soy, somatic embryos were harvested and lipid fatty acid profiles were analyzed exactly as described in Example 13, and results are summarized in TABLEs 33, 34 and 35, respectively.

In the Tables, the fatty acid profiles as a weight percent of total fatty acids are shown where 16:0 is palmitic acid, 18:0 is stearic acid, 18:1 is oleic acid, 18:2 is linoleic acid, 18:3 is alpha-linolenic acid, EDA is eicosadienoic acid [20:2($\Delta$1, 14)], DGLA is dihomo-gamma-linolenic acid, ERA is eicosatrienoic acid [20:3($\Delta$11,14,17)] and ETA is eicosatetraenoic acid [20:1($\Delta$8,11,14,17)]. The sum of EDA+ERA and DGLA+ETA is also shown. Results for each event are sorted according to DGLA+ETA concentrations in decreasing order. The average fatty acid profiles for the five events having highest DGLA+ETA content from each experiment are also shown in each table (Avg. **)

TABLE 33

Fatty Acid Analysis from Soy Somatic Embyros transformed with pKR1560 comprising EgD9Elo and TpomD8Des (MSE2602).

| Event # | 16:0 | 18:0 | 18:1 | 18:2 | 18:3 | EDA | DGLA | ERA | ETA | EDA + ERA | DGLA + ETA |
|---|---|---|---|---|---|---|---|---|---|---|---|
| 14 | 15.5 | 5.2 | 19.4 | 25.6 | 7.4 | 8.9 | 13.8 | 0.8 | 3.4 | 9.7 | 17.2 |
| 20 | 14.5 | 6.2 | 19.4 | 25.4 | 5.1 | 14.6 | 10.6 | 1.3 | 2.7 | 16.0 | 13.3 |
| 8 | 15.6 | 5.1 | 17.3 | 26.0 | 8.5 | 13.4 | 9.7 | 1.6 | 2.8 | 15.0 | 12.5 |
| 17 | 14.9 | 5.4 | 18.1 | 22.0 | 6.7 | 18.1 | 9.1 | 2.6 | 3.0 | 20.6 | 12.1 |
| 11 | 15.3 | 5.3 | 18.9 | 26.5 | 8.2 | 12.8 | 9.5 | 1.2 | 2.5 | 14.0 | 12.0 |
| 21 | 14.1 | 5.7 | 21.6 | 25.0 | 5.6 | 15.0 | 9.2 | 1.4 | 2.4 | 16.5 | 11.6 |
| 23 | 14.6 | 5.4 | 20.0 | 26.9 | 7.5 | 15.2 | 6.6 | 2.2 | 1.6 | 17.3 | 8.3 |
| 29 | 14.8 | 5.8 | 21.7 | 27.8 | 8.5 | 13.5 | 4.6 | 1.7 | 1.5 | 15.2 | 6.2 |
| 6 | 14.8 | 5.1 | 15.5 | 25.9 | 8.9 | 20.6 | 3.9 | 3.9 | 1.5 | 24.5 | 5.4 |
| 9 | 18.2 | 4.7 | 14.7 | 37.4 | 16.1 | 3.3 | 4.2 | 0.4 | 1.0 | 3.8 | 5.2 |
| 1 | 13.2 | 9.0 | 19.2 | 26.0 | 6.2 | 18.9 | 3.9 | 2.7 | 0.9 | 21.6 | 4.8 |
| 22 | 12.7 | 6.9 | 16.1 | 24.8 | 5.5 | 25.6 | 3.3 | 3.8 | 1.3 | 29.4 | 4.6 |
| 3 | 15.4 | 6.4 | 22.4 | 29.0 | 9.9 | 11.0 | 3.0 | 1.9 | 1.0 | 12.9 | 4.0 |
| 30 | 15.5 | 7.0 | 26.1 | 29.9 | 9.9 | 6.7 | 2.9 | 1.2 | 1.0 | 7.8 | 3.9 |
| 16 | 17.7 | 4.5 | 11.7 | 39.8 | 18.5 | 3.7 | 2.2 | 0.6 | 1.3 | 4.3 | 3.4 |
| 26 | 13.4 | 8.4 | 17.9 | 30.3 | 7.4 | 17.5 | 1.5 | 3.0 | 0.4 | 20.5 | 2.0 |
| 25 | 17.3 | 6.5 | 17.7 | 36.2 | 14.9 | 5.1 | 0.9 | 1.1 | 0.4 | 6.2 | 1.3 |
| 5 | 13.5 | 5.4 | 16.2 | 26.6 | 10.2 | 20.9 | 0.7 | 6.1 | 0.5 | 27.0 | 1.2 |
| 15 | 18.0 | 5.4 | 15.2 | 40.8 | 19.0 | 0.5 | 0.8 | 0.1 | 0.2 | 0.6 | 1.0 |
| 28 | 17.6 | 4.7 | 16.3 | 42.5 | 15.7 | 2.2 | 0.4 | 0.3 | 0.3 | 2.5 | 0.7 |
| 2 | 19.2 | 5.9 | 13.8 | 43.2 | 16.9 | 0.8 | 0.1 | 0.1 | 0.0 | 0.9 | 0.1 |
| 4 | 16.7 | 5.1 | 16.3 | 33.6 | 15.5 | 10.2 | 0.0 | 2.6 | 0.0 | 12.7 | 0.0 |
| 7 | 18.2 | 5.6 | 16.1 | 41.6 | 17.5 | 0.9 | 0.0 | 0.2 | 0.0 | 1.1 | 0.0 |
| 10 | 18.1 | 4.6 | 15.0 | 40.7 | 21.6 | 0.0 | 0.0 | 0.0 | 0.0 | 0.0 | 0.0 |
| 12 | 17.8 | 5.7 | 17.9 | 38.5 | 15.9 | 3.2 | 0.0 | 1.0 | 0.0 | 4.2 | 0.0 |
| 13 | 18.7 | 4.8 | 13.1 | 41.1 | 22.1 | 0.2 | 0.0 | 0.0 | 0.0 | 0.2 | 0.0 |
| 18 | 12.7 | 7.0 | 18.4 | 27.3 | 6.6 | 23.3 | 0.0 | 4.7 | 0.0 | 28.0 | 0.0 |
| 19 | 19.7 | 4.4 | 11.5 | 40.7 | 23.6 | 0.2 | 0.0 | 0.0 | 0.0 | 0.2 | 0.0 |
| 24 | 15.9 | 6.1 | 21.2 | 39.8 | 12.4 | 4.0 | 0.0 | 0.7 | 0.0 | 4.7 | 0.0 |
| 27 | 17.7 | 5.7 | 16.8 | 40.1 | 19.4 | 0.2 | 0.0 | 0.0 | 0.0 | 0.3 | 0.0 |
| Avg.** | 15.1 | 5.5 | 18.6 | 25.1 | 7.2 | 13.6 | 10.5 | 1.5 | 2.9 | 15.1 | 13.4 |

TABLE 34

Fatty Acid Analysis from Soy Somatic Embyros transformed with pKR1550 comprising EgD9Elo, TpomD8Des and McMBOAT (MSE2600)

| Event # | 16:0 | 18:0 | 18:1 | 18:2 | 18:3 | EDA | DGLA | ERA | ETA | EDA + ERA | DGLA + ETA |
|---|---|---|---|---|---|---|---|---|---|---|---|
| 5 | 14.1 | 6.2 | 24.0 | 19.1 | 4.9 | 11.1 | 16.2 | 0.9 | 3.4 | 12.0 | 19.6 |
| 28 | 16.3 | 5.7 | 17.1 | 25.2 | 8.7 | 8.0 | 14.1 | 0.9 | 4.1 | 8.9 | 18.2 |
| 12 | 14.7 | 6.0 | 23.2 | 23.2 | 6.3 | 7.8 | 13.9 | 0.9 | 4.0 | 8.7 | 17.9 |
| 21 | 14.2 | 6.1 | 27.1 | 18.9 | 6.3 | 8.5 | 14.3 | 0.9 | 3.6 | 9.4 | 17.9 |
| 8 | 15.6 | 5.1 | 22.3 | 22.9 | 8.0 | 7.7 | 13.5 | 1.0 | 4.0 | 8.7 | 17.5 |
| 27 | 14.8 | 6.1 | 24.1 | 21.0 | 6.4 | 10.2 | 13.4 | 0.9 | 3.3 | 11.1 | 16.7 |
| 14 | 15.2 | 5.8 | 24.5 | 21.4 | 7.1 | 8.8 | 12.7 | 1.0 | 3.5 | 9.8 | 16.2 |
| 18 | 14.0 | 5.3 | 15.8 | 23.6 | 6.7 | 17.7 | 11.4 | 2.2 | 3.3 | 19.9 | 14.7 |
| 10 | 15.7 | 5.3 | 21.5 | 22.7 | 9.0 | 9.9 | 10.8 | 1.5 | 3.6 | 11.4 | 14.4 |
| 4 | 13.7 | 6.3 | 25.6 | 19.9 | 5.6 | 13.5 | 11.8 | 1.2 | 2.4 | 14.7 | 14.3 |
| 26 | 16.3 | 4.8 | 15.4 | 27.5 | 11.3 | 9.5 | 10.3 | 1.2 | 3.7 | 10.7 | 14.0 |
| 17 | 16.5 | 4.6 | 13.6 | 27.9 | 12.9 | 10.5 | 9.2 | 1.6 | 3.3 | 12.1 | 12.5 |
| 16 | 15.0 | 5.6 | 21.0 | 24.8 | 8.2 | 11.6 | 9.1 | 1.5 | 3.1 | 13.2 | 12.3 |
| 29 | 15.9 | 6.5 | 25.7 | 28.0 | 10.2 | 3.9 | 7.5 | 0.4 | 2.0 | 4.3 | 9.4 |
| 20 | 13.4 | 6.1 | 21.6 | 23.9 | 7.0 | 16.6 | 7.3 | 2.4 | 1.6 | 19.0 | 8.9 |
| 13 | 15.6 | 6.8 | 21.3 | 29.0 | 12.0 | 6.7 | 5.4 | 1.3 | 1.9 | 8.0 | 7.3 |
| 2 | 18.2 | 4.4 | 13.9 | 35.2 | 13.5 | 8.0 | 4.0 | 1.3 | 1.4 | 9.3 | 5.4 |
| 23 | 18.1 | 4.9 | 15.1 | 37.2 | 18.4 | 1.8 | 3.5 | 0.2 | 0.9 | 2.0 | 4.4 |
| 3 | 17.3 | 5.1 | 16.0 | 38.2 | 18.4 | 1.8 | 1.9 | 0.3 | 0.9 | 2.1 | 2.8 |
| 22 | 14.0 | 4.8 | 14.9 | 25.2 | 8.2 | 25.8 | 1.7 | 4.8 | 0.6 | 30.6 | 2.3 |
| 25 | 17.8 | 5.2 | 16.4 | 36.9 | 22.1 | 0.7 | 0.7 | 0.0 | 0.3 | 0.7 | 0.9 |
| 19 | 15.1 | 5.4 | 18.4 | 32.4 | 12.2 | 13.1 | 0.4 | 2.9 | 0.1 | 16.0 | 0.5 |
| 1 | 18.5 | 4.5 | 13.9 | 37.8 | 24.4 | 0.6 | 0.3 | 0.0 | 0.0 | 0.6 | 0.3 |
| 11 | 14.5 | 6.4 | 23.1 | 29.6 | 10.4 | 12.5 | 0.2 | 3.3 | 0.0 | 15.8 | 0.2 |
| 6 | 18.8 | 5.2 | 12.5 | 43.8 | 19.5 | 0.2 | 0.0 | 0.0 | 0.0 | 0.2 | 0.0 |
| 7 | 18.1 | 4.8 | 13.7 | 43.1 | 19.8 | 0.3 | 0.0 | 0.2 | 0.0 | 0.5 | 0.0 |
| 9 | 17.1 | 4.8 | 16.5 | 40.1 | 21.4 | 0.1 | 0.0 | 0.0 | 0.0 | 0.1 | 0.0 |
| 15 | 18.4 | 5.5 | 13.9 | 41.5 | 20.5 | 0.2 | 0.0 | 0.0 | 0.0 | 0.2 | 0.0 |
| 24 | 18.3 | 4.8 | 15.0 | 40.6 | 21.2 | 0.1 | 0.0 | 0.0 | 0.0 | 0.1 | 0.0 |
| Avg.** | 15.0 | 5.8 | 22.7 | 21.9 | 6.9 | 8.6 | 14.4 | 0.9 | 3.8 | 9.5 | 18.2 |

TABLE 35

Fatty Acid Analysis from Soy Somatic Embyros transformed with pKR1558 comprising EgD9Elo, TpomD8Des and CoMBOAT (MSE2601)

| Event # | 16:0 | 18:0 | 18:1 | 18:2 | 18:3 | EDA | DGLA | ERA | ETA | EDA + ERA | DGLA + ETA |
|---|---|---|---|---|---|---|---|---|---|---|---|
| 21 | 14.2 | 5.2 | 17.9 | 16.8 | 4.5 | 18.0 | 18.9 | 1.2 | 3.4 | 19.2 | 22.3 |
| 20 | 16.0 | 5.1 | 17.2 | 23.6 | 8.2 | 10.2 | 16.0 | 0.7 | 3.1 | 10.9 | 19.0 |
| 2 | 18.1 | 4.1 | 7.1 | 25.8 | 16.4 | 8.4 | 13.7 | 1.6 | 4.8 | 10.0 | 18.5 |
| 4 | 14.3 | 5.8 | 20.4 | 20.0 | 5.9 | 14.2 | 14.5 | 1.4 | 3.6 | 15.6 | 18.1 |
| 10 | 14.8 | 6.1 | 20.1 | 19.9 | 5.1 | 14.9 | 14.5 | 1.2 | 3.4 | 16.2 | 17.9 |
| 19 | 17.2 | 4.8 | 15.5 | 24.9 | 9.8 | 9.0 | 13.6 | 1.1 | 4.1 | 10.1 | 17.7 |
| 17 | 15.6 | 5.0 | 20.8 | 20.0 | 5.9 | 13.9 | 14.3 | 1.1 | 3.3 | 15.0 | 17.6 |
| 1 | 15.6 | 5.4 | 16.2 | 21.5 | 5.6 | 17.0 | 13.3 | 1.7 | 3.6 | 18.7 | 17.0 |
| 30 | 14.1 | 6.0 | 15.0 | 20.8 | 4.7 | 22.0 | 13.0 | 1.7 | 2.8 | 23.7 | 15.8 |
| 11 | 14.0 | 7.1 | 29.9 | 18.0 | 4.9 | 11.0 | 11.1 | 1.1 | 2.8 | 12.1 | 14.0 |
| 24 | 14.4 | 6.5 | 21.7 | 21.8 | 5.5 | 15.2 | 10.7 | 1.4 | 2.7 | 16.7 | 13.4 |
| 15 | 16.1 | 5.1 | 15.2 | 29.9 | 10.3 | 9.7 | 10.2 | 1.0 | 2.6 | 10.7 | 12.7 |
| 5 | 15.9 | 5.1 | 19.0 | 21.8 | 8.6 | 15.1 | 9.3 | 2.2 | 3.0 | 17.3 | 12.3 |
| 23 | 13.8 | 8.8 | 18.4 | 25.9 | 6.6 | 15.2 | 7.7 | 1.6 | 1.9 | 16.8 | 9.5 |
| 6 | 14.2 | 5.8 | 21.9 | 20.5 | 7.2 | 17.5 | 6.8 | 3.5 | 2.7 | 21.0 | 9.5 |
| 16 | 16.1 | 6.0 | 19.5 | 30.3 | 11.5 | 6.8 | 7.2 | 0.6 | 2.0 | 7.4 | 9.2 |
| 13 | 16.0 | 5.4 | 17.9 | 29.8 | 12.6 | 10.4 | 4.7 | 1.6 | 1.5 | 12.0 | 6.2 |
| 27 | 17.9 | 5.1 | 16.4 | 35.4 | 17.4 | 2.8 | 3.5 | 0.5 | 1.0 | 3.3 | 4.5 |
| 28 | 14.7 | 5.7 | 24.3 | 29.1 | 6.7 | 14.6 | 2.0 | 2.1 | 0.8 | 16.8 | 2.8 |
| 7 | 10.8 | 7.5 | 22.8 | 16.3 | 3.4 | 32.7 | 1.8 | 4.2 | 0.6 | 36.9 | 2.4 |
| 22 | 15.1 | 5.4 | 19.0 | 29.4 | 13.0 | 12.7 | 1.6 | 3.4 | 0.4 | 16.1 | 2.0 |
| 8 | 17.8 | 6.1 | 20.6 | 39.1 | 14.5 | 0.6 | 1.3 | 0.0 | 0.0 | 0.6 | 1.3 |
| 25 | 17.1 | 5.8 | 22.8 | 35.8 | 17.0 | 0.7 | 0.5 | 0.0 | 0.2 | 0.7 | 0.7 |
| 18 | 18.1 | 6.2 | 17.4 | 37.6 | 19.3 | 0.6 | 0.4 | 0.0 | 0.3 | 0.6 | 0.7 |
| 12 | 14.1 | 4.7 | 16.5 | 28.4 | 7.2 | 23.4 | 0.5 | 5.1 | 0.1 | 28.5 | 0.6 |
| 3 | 18.4 | 6.3 | 17.2 | 37.8 | 19.7 | 0.4 | 0.3 | 0.0 | 0.0 | 0.4 | 0.3 |
| 9 | 14.5 | 6.0 | 25.9 | 26.7 | 8.9 | 15.2 | 0.0 | 2.9 | 0.0 | 18.1 | 0.0 |
| 14 | 14.5 | 5.3 | 15.0 | 34.3 | 10.1 | 17.1 | 0.0 | 3.6 | 0.0 | 20.8 | 0.0 |
| 26 | 17.2 | 6.5 | 17.5 | 38.7 | 20.2 | 0.0 | 0.0 | 0.0 | 0.0 | 0.0 | 0.0 |
| 29 | 15.6 | 5.1 | 13.1 | 33.0 | 11.8 | 17.4 | 0.0 | 3.9 | 0.0 | 21.3 | 0.0 |
| Avg.** | 15.5 | 5.2 | 16.5 | 21.2 | 8.0 | 13.2 | 15.5 | 1.2 | 3.6 | 14.4 | 19.2 |

A summary of the average fatty acid profiles for the five events having highest DGLA+ETA content from each experiment (Avg. **) is shown in TABLE 36. In TABLE 36, the calculated % delta-9 elongation conversion efficiency (% D9Elo) is also shown for the average of the five events having highest DGLA+ETA content from each experiment where the % D9Elo was calculated by dividing the sum of the average weight percent (wt. %) for EDA, ERA, DGLA and ETA by the sum of the average wt. % for 18:2, 18:3, EDA, ERA, DGLA and ETA and multiplying by 100 to express as a %. Similarly, the calculated % delta-8 desaturation conversion efficiency (% D8) is shown in TABLE 36 for the average of the five events having highest DGLA+ETA content from each experiment where the % D8 was calculated by dividing the sum of the average weight percent (wt. %) for DGLA and ETA by the sum of the average wt. % for EDA, ERA, DGLA and ETA and multiplying by 100 to express as a %. Also shown in TABLE 36 is the relative % delta-9 elongation (Rel % D9Elo) and relative % delta-8 desaturation (Rel % D8) for each experiment where the % D69Elo or % D8 for the experiment is divided by the % D9Elo or % D8 for that of MSE2602 (EgD9Elo, TpomD8Des).

promoter and transcription terminator sequences for use in embryo-specific expression in soybean. Furthermore, PCT Publication Nos. WO 2004/071467 and U.S. Pat. No. 7,129,089 describe the synthesis of multiple promoter/gene/terminator cassette combinations by ligating individual promoters, genes, and transcription terminators together in unique combinations. Generally, a NotI site flanked by the suitable promoter (such as those listed in, but not limited to, Table 37) and a transcription terminator (such as those listed in, but not limited to, Table 38) is used to clone the desired gene. NotI sites can be added to a gene of interest using PCR amplification with oligonucleotides designed to introduce NotI sites at the 5' and 3' ends of the gene. The resulting PCR product is then digested with NotI and cloned into a suitable promoter/NotI/terminator cassette. Although gene cloning into expression cassettes is often done using the NotI restriction enzyme, one skilled in the art can appreciate that a number of restriction enzymes can be utilized to achieve the desired cassette. Further, one skilled in the will appreciate that other cloning techniques including, but not limited to, PCR-based or recombination-based techniques can be used to generate suitable expression cassettes.

TABLE 36

Comparison of the average fatty acid profiles for MBOATs co-expressed with a delta-9 elongase PUFA pathway in Soy Somatic Embryos

| Experiment | 16:0 | 18:0 | 18:1 | 18:2 | 18:3 | EDA | DGLA | ERA | ETA | EDA + ERA | EDA + ERA | DGLA + ETA | % D9 Elo | % D8 | Rel % D9 Elo | Rel % D8 |
|---|---|---|---|---|---|---|---|---|---|---|---|---|---|---|---|---|
| MSE2602 (EgD9Elo, TpomD8Des) | 15.1 | 5.5 | 18.6 | 25.1 | 7.2 | 13.6 | 10.5 | 1.5 | 2.9 | 15.1 | 15.1 | 13.4 | 42.4 | 47.6 | 1.00 | 1.00 |
| MSE2600 (EgD9Elo, TpomD8Des, McMBOAT) | 15.0 | 5.8 | 22.7 | 21.9 | 6.9 | 8.6 | 14.4 | 0.9 | 3.8 | 9.5 | 9.5 | 18.2 | 47.7 | 65.8 | 1.12 | 1.38 |
| MSE2601 (EgD9Elo, TpomD8Des, CoMBOAT) | 15.5 | 5.2 | 16.5 | 21.2 | 8.0 | 13.2 | 15.5 | 1.2 | 3.6 | 14.4 | 14.4 | 19.2 | 49.2 | 57.7 | 1.16 | 1.21 |

TABLEs 33-36 demonstrate that co-expression of either McMBOAT or CoMBOAT along with EgD9elo and TpomD8Des leads to higher activities for both % D9Elo and % D8 activity in soy somatic embryos. These higher activities result in higher concentrations of DGLA+ETA being made.

Example 17

Expression Vectors For Co-Expression of MBOAT and DGAT2 Genes With Unusual Fatty Acid Biosynthetic Genes and/or PUFA Genes In addition to the genes, promoters, terminators and gene cassettes described herein, one skilled in the art can appreciate that other promoter/gene/terminator cassette combinations can be synthesized in a way similar to, but not limited to, that described herein for the co-expression of MBOAT and DGAT2 genes with unusual fatty acid biosynthetic genes. Similarly, it may be desirable to co-express MBOATs of the present invention or other MBOAT genes and DGAT2 genes of the present invention or other DGAT2 genes with the unusual fatty acid biosynthetic genes of the present invention (CoConj, McConj, EgD9Elo, TpomD8Des, MaD6Des or MaElo) or other unusual fatty acid biosynthetic genes.

For instance, PCT Publication No. WO 2004/071467 and U.S. Pat. No. 7,129,089 describe the isolation of a number of

TABLE 37

Seed-specific Promoters

| Promoter | Organism | Promoter Reference |
|---|---|---|
| β-conglycinin α'-subunit | soybean | Beachy et al., EMBO J. 4: 3047-3053 (1985) |
| kunitz trypsin inhibitor | soybean | Jofuku et al., Plant Cell 1: 1079-1093 (1989) |
| Annexin | soybean | U.S. Pat. No. 7,129,089 |
| glycinin Gy1 | soybean | WO 2004/071467 |
| albumin 2S | soybean | U.S. Pat. No. 6,177,613 |
| legumin A1 | pea | Rerie et al., Mol. Gen. Genet. 225: 148-157 (1991) |
| β-conglycinin β-subunit | soybean | WO 2004/071467 |
| BD30 (also called P34) | soybean | U.S. Pat. No. 7,129,089 |
| legumin A2 | pea | Rerie et al., Mol. Gen. Genet. 225: 148-157 (1991) |

TABLE 38

Transcription Terminators

| Transcription Terminator | Organism | Reference |
|---|---|---|
| phaseolin 3' | bean | WO 2004/071467 |
| kunitz trypsin inhibitor 3' | soybean | WO 2004/071467 |

TABLE 38-continued

Transcription Terminators

| Transcription Terminator | Organism | Reference |
|---|---|---|
| BD30 (also called P34) 3' | soybean | WO 2004/071467 |
| legumin A2 3' | pea | WO 2004/071467 |
| albumin 2S 3' | soybean | WO 2004/071467 |

In addition, WO 2004/071467 and U.S. Pat. No. 7,129,089 describe the further linking together of individual promoter/gene/transcription terminator cassettes in unique combinations and orientations, along with suitable selectable marker cassettes, in order to obtain the desired phenotypic expression. Although this is done mainly using different restriction enzymes sites, one skilled in the art can appreciate that a number of techniques can be utilized to achieve the desired promoter/gene/transcription terminator combination or orientations. In so doing, any combination and orientation of embryo-specific promoter/gene/transcription terminator cassettes can be achieved. One skilled in the art can also appreciate that these cassettes can be located on individual DNA fragments or on multiple fragments where co-expression of genes is the outcome of co-transformation of multiple DNA fragments.

Unusual fatty acid biosynthetic enzyme encoding genes (such as those listed in, but not limited to, Table 39) can be co-expressed with MBOAT and/or DGAT2 genes using techniques described herein. NotI restriction enzyme sites flanking unusual fatty acid biosynthetic genes are added, cloned into soybean expression vectors behind suitable promoters and are co-expressed with MBOAT and/or DGAT2 genes using methods described herein. Genes can also be synthesized with appropriate restriction sites flanking the gene of interest.

Similarly, it may be desirable to express other PUFA genes (such as those described below in Table 39), for co-expression with MBOAT and/or DGAT2 genes of the present invention.

TABLE 39

Unusual Fatty Acid Biosynthetic Gene and Protein Sequences

| Function | Organism | Reference | nt SEQ ID NO: | aa SEQ ID NO: |
|---|---|---|---|---|
| desaturase | *Vernonia galamensis* | 5,846,784 | 77 | 78 |
| epoxidase | *Vernonia galamensis* | 5,846,784 | 79 | 80 |
| delta-5 acyl-CoA desaturase | *Limanthes alba* | 6,838,594 & 7,495,149 | 81 | 82 |
| fatty acyl-CoA elongase | *Limnanthes alba* | 6,838,594 & 7,495,149 | 83 | 84 |
| conjugase | *Impatiens balsamina* | 7,244,563 | 85 | 86 |
| conjugase | *Momordica charantia* | 7,244,563 | 87 | 88 |
| conjugase | *Chrysobalanus icaco* | 7,244,563 | 89 | 90 |
| conjugase | *Licania michauxii* | 7,244,563 | 91 | 92 |
| conjugase | *Aleurites fordii* | 7,244,563 | 93 | 94 |
| Class II conjugase | *Aleurites fordii* | 7,244,563 | 95 | 96 |
| hydroxylase | *Ricinis communis* | 7,244,563 Gi:722351 | — | 97 |
| Conjugase (delta-9, CalFad2-1) | *Calendula officialis* | 6,593,514 & 7,230,090 | 98 | 99 |
| Conjugase (delta-9, CalFad2-2) | *Calendula officialis* | 6,593,514 & 7,230,090 | 100 | 101 |
| Conjugase (delta-12, DMFad2-1) | *Dimorphotheca sinuata* | 6,593,514 & 7,230,090 | 102 | 103 |
| Conjugase (delta-9, DMFad2-2) | *Dimorphotheca sinuata* | 6,593,514 & 7,230,090 | 104 | 105 |

TABLE 40

PUFA Biosynthetic Pathway Genes

| Gene | Organism | Reference |
|---|---|---|
| delta-6 desaturase | *Saprolegnia diclina* | WO 2002/081668 |
| delta-6 desaturase | *Mortierella alpina* | U.S. Pat. No. 5,968,809 |
| elongase | *Mortierella alpina* | WO 2000/12720 U.S. Pat. No. 6,403,349 |
| delta-5 desaturase | *Mortierella alpina* | U.S. Pat. No. 6,075,183 |
| delta-5 desaturase | *Saprolegnia diclina* | WO 2002/081668 |
| delta-5 desaturase | *Peridinium* sp. | U.S. patent application No. 11/748,637 |
| delta-5 desaturase | *Euglena gracilis* | U.S. patent application No. 11/748,629 |
| delta-15 desaturase | *Fusarium moniliforme* | WO 2005/047479 |
| delta-17 desaturase | *Saprolegnia diclina* | WO 2002/081668 |
| elongase | *Thraustochytrium aureum* | WO 2002/08401 U.S. Pat. No. 6,677,145 |
| elongase | *Pavlova* sp. | Pereira et al., Biochem. J. 384: 357-366 (2004) |
| delta-4 desaturase | *Schizochytrium aggregatum* | WO 2002/090493 U.S. Pat. No. 7,045,683 |
| delta-4 desaturase | *Isochrysis galbana* | WO 2002/090493 U.S. Pat. No. 7,045,683 |
| delta-4 desaturase | *Thraustochytrium aureum* | WO 2002/090493 U.S. Pat. No. 7,045,683 |
| delta-4 desaturase | *Euglena gracilis* | U.S. patent application No. 10/552,127 |
| delta-9 elongase | *Isochrysis galbana* | WO 2002/077213 |
| delta-9 elongase | *Euglena gracilis* | U.S. patent application No. 11/601,563 |
| delta-9 elongase | *Eutreptiella* sp. CCMP389 | U.S. patent application No. 11/601,564 |
| delta-8 desaturase | *Euglena gracilis* | WO 2000/34439 U.S. Pat. No. 6,825,017 WO 2004/057001 WO 2006/012325 |
| delta-8 desaturase | *Euglena gracilis* | WO 2000/34439 U.S. Pat. No. 6,825,017 WO 2004/057001 WO 2006/012325 |
| delta-8 desaturase | *Acanthamoeba castellanii* | Sayanova et al., FEBS Lett. 580: 1946-1952 (2006) |

TABLE 40-continued

PUFA Biosynthetic Pathway Genes

| Gene | Organism | Reference |
|---|---|---|
| delta-8 desaturase | Pavlova salina | WO 2005/103253 |
| delta-8 desaturase | Pavlova lutheri | U.S. patent application No. 11/737,772 |
| delta-8 desaturase | Tetruetreptia pomquetensis CCMP1491 | U.S. patent application No. 11/876,115 |
| delta-8 desaturase | Eutreptiella sp. CCMP389 | U.S. patent application No. 11/876,115 |
| delta-8 desaturase | Eutreptiella cf_gymnastica CCMP1594 | U.S. patent application No. 11/876,115 |

For example, cloning of the *Ricinus communis* fatty acid hydroxylase (RcHyd; SEQ ID NO:97) from cDNA was described previously in U.S. Pat. No. 7,244,563. RcHyd is PCR amplified from cDNA using the Phusion™ High-Fidelity DNA Polymerase (Cat. No. F553S, Finnzymes Oy, Finland) following the manufacturer's protocol and using oligonucleotide RcHydroxy-5 (SEQ ID NO:108) and RcHydroxy-3 (SEQ ID NO:109, which are designed to add NotI sites flanking RcHyd.

The resulting DNA fragment is cloned into the pCR-Blunt® cloning vector using the Zero Blunt® PCR Cloning Kit (Invitrogen Corporation), following the manufacturer's protocol The NotI fragment, containing RcHyd, is cloned into the NotI site of pKR72, which was previously described in PCT Publication No. WO 2004/071467 (the contents of which is incorporated by reference), to produce a soybean expression vector where RcHyd is under control of the soy beta-conglycinin promoter.

Either McMBOAT or CoMBOAT, under control of the KTi promoter, can be released from intermediate cloning vectors described herein by digestion with BsiWI and the fragment containing the MBOAT gene is cloned into the BsiWI site of the soy expression vector containing RcHyd to produce a soy expression vector where RcHyd is under control of the soy beta-conglycinin promoter and either McMBOAT or CoMBOAT is under control of the KTi promoter.

Further, the SbfI fragment of pKR1543 (SEQ ID NO:29), containing McDGAT2 or the PstI fragment of pKR1493 (SEQ ID NO:40), containing CoDGAT2 can be cloned into these vectors to produced soybean expression vectors where the RcHyd is under control of the soy beta-conglycinin promoter, MBOAT is under control of the KTi promoter and DGAT2 is under control of the soy glycinin Gy1 promoter.

Subsequent cleavage of these vectors with BsiWI followed by relegation of the fragment containing RcHyd and either DGAT2 produces soy expression vectors where RcHyd is under control of the soy beta-conglycinin promoter and DGAT2 is under control of the soy glycinin Gy1 promoter.

Cloning the AscI fragments from these soy expression vectors into the AscI site of pKR92 produces the corresponding set of *Arabidopsis* expression vectors or expressing RcHyd with MBOAT and/or DGAT2 in *Arabidopsis* seed.

Example 18

Construction of Soybean Expression Vectors for Co-Expressing *Ricinus communis* Hydroxylase (RcHyd) with McDGAT2 and/or McMBOAT and for Co-Expressing *Ricinus communis* Hydroxylase (RcHyd) with CoDGAT2 and/or CoMBOAT The *Ricinus communis* (Castor) fatty acid hydroxylase (RcHyd; SEQ ID NO:97) was described previously in U.S.

Pat. No. 7,244,563. RcHyd was PCR amplified from cDNA using oligonucleotide RcHydroxy-5 (SEQ ID NO:108) and RcHydroxy-3 (SEQ ID NO:109) exactly as described in Example 17.

The resulting DNA fragment was cloned into the pCR-Blunt® cloning vector using the Zero Blunt® PCR Cloning Kit (Invitrogen Corporation), following the manufacturer's protocol to produce pLF241 (SEQ ID NO:110).

The NotI fragment of pLF241 (SEQ ID NO:110), containing RcHyd gene, was cloned into the NotI site of pKR72, which was previously described in PCT Publication No. WO 2004/071467, to produce pKR1687 (SEQ ID NO:111). In pKR1687, RcHyd is under control of the soy beta-conglycinin promoter. RcHyd generates the hydroxylated fatty acid (Ricinoleic acid) when expressed in soy.

The NotI fragment of pLF166 (SEQ ID NO:48), containing CoMBOAT, was cloned into the NotI site of pKR457, which was previously described in No. U.S. Pat. No. 7,256,033. The resulting intermediate vector containing CoMBOAT under control of the soy KTi promoter was digested with BsiWI, and the fragment containing CoMBOAT was cloned into the BsiWI site of pKR1687 (SEQ ID NO:111) to produce pKR1742 (SEQ ID NO:112). In pKR1742, RcHyd is under control of the soy beta-conglycinin promoter, and CoMBOAT is under control of the KTi promoter.

The PstI fragment of pKR1493 (SEQ ID NO:40), containing CoDGAT2, was cloned into the SbfI site of pKR1687 (SEQ ID NO:111) to produce pKR1733 (SEQ ID NO:113). In pKR1733, RcHyd is under control of the soy beta-conglycinin promoter, and CoDGAT2 is under control of the soy glycinin Gy1 promoter.

The NotI fragment of pLF166 (SEQ ID NO:48), containing CoMBOAT, was cloned into the NotI site of pKR457, which was previously described in No. U.S. Pat. No. 7,256,033. The resulting intermediate vector containing CoMBOAT under control of the soy KTi promoter was digested with BsiWI, and the fragment containing CoMBOAT was cloned into the BsiWI site of pKR1733 (SEQ ID NO:113) to produce pKR1745 (SEQ ID NO:114). In pKR1745, RcHyd is under control of the soy beta-conglycinin promoter, CoDGAT2 is under control of the soy glycinin Gy1 promoter and CoMBOAT is under control of the KTi promoter.

A starting vector, pKR966 (SEQ ID NO:115) contains the *Schizochytrium aggregatum* delta-4 desaturase flanked by NotI sites behind the soy KTi promoter and followed by the soy KTi3 and soy albumin double terminator (described in BB1538).

The NotI fragment of pHD41 (SEQ ID NO:34), containing McMBOAT, was cloned into the NotI site of pKR966 (SEQ ID NO:115), containing the soy KTi promoter, to produce pKR1542 (SEQ ID NO:116).

The BsiWI fragment of pKR1542 (SEQ ID NO:116), containing McMBOAT, was cloned into the BsiWI site of pKR1687 (SEQ ID NO:111) to produce pKR1743 (SEQ ID NO:117). In pKR1743, RcHyd is under control of the soy beta-conglycinin promoter, and McMBOAT is under control of the KTi promoter.

The SbfI fragment of pKR1543 (SEQ ID NO:29), containing McDGAT2, was cloned into the SbfI site of pKR1687 (SEQ ID NO:111) to produce pKR1734 (SEQ ID NO:118). In pKR1734, RcHyd is under control of the soy beta-conglycinin promoter, and McDGAT2 is under control of the soy glycinin Gy1 promoter.

The BsiWI fragment of pKR1542 (SEQ ID NO:116), containing McMBOAT, was cloned into the BsiWI site of pKR1734 (SEQ ID NO:118) to produce pKR1746 (SEQ ID NO:119). In pKR1746, RcHyd is under control of the soy beta-conglycinin promoter, McMBOAT is under control of the KTi promoter and McDGAT2 is under control of the soy glycinin Gy1 promoter.

Example 19

Co-Expressing RcHyd with McDGAT2 and/or McMBOAT or CoDGAT2 and/or CoMBOAT in Soy Somatic Embryos Soybean expression vectors pKR1687 (SEQ ID NO:111), comprising RcHyd, pKR1742 (SEQ ID NO:112), comprising RcHyd and CoMBOAT, pKR1733 (SEQ ID NO:113), comprising RcHyd and CoDGAT2, pKR1745 (SEQ ID NO:114), comprising RcHyd, CoMBOAT and CoDGAT2, pKR1743 (SEQ ID NO:117), comprising RcHyd and McMBOAT, pKR1734 (SEQ ID NO:118), comprising RcHyd and McDGAT2 and pKR1746 (SEQ ID NO:119), comprising RcHyd, McMBOAT and McDGAT2 were transformed into soy, and lipid fatty acid profiles and oil contents were analyzed as described within.

Fatty acid profiles for approximately 30 events from each transformation are summarized in TABLEs 41, 42, 43, 44, 45, 46 and 47, respectively.

In the Tables, the fatty acid profiles as a weight percent of total fatty acids are shown where 16:0 is palmitic acid, 18:0 is stearic acid, 18:1 is oleic acid, 18:2 is linoleic acid, 18:3 is alpha-linolenic acid and Rcn is ricinoleic acid. Results for each event are sorted according to RCN concentrations in decreasing order. The average fatty acid profiles for the five events having highest RCN content from each experiment are also shown in each table (Avg. **) where only events having eleostearic acid greater than 1% are included in the average calculation.

TABLE 41

Fatty Acid Analysis from Soy Somatic Embyros transformed with pKR1687 comprising RcHyd (MSE2738)
MSE2738 (RcHyd)

| Event # | 16:0 | 18:0 | 18:1 | 18:2 | 18:3 | Rcn | % Hydrox |
|---|---|---|---|---|---|---|---|
| 2738-7 | 16.6 | 7.0 | 24.9 | 34.8 | 14.0 | 2.7 | 9.9 |
| 2738-20 | 17.0 | 5.2 | 19.3 | 41.6 | 15.2 | 1.6 | 7.7 |
| 2738-6 | 16.4 | 3.7 | 13.2 | 50.5 | 14.7 | 1.4 | 9.8 |
| 2738-10 | 16.8 | 6.1 | 24.3 | 35.5 | 15.9 | 1.4 | 5.5 |
| 2738-12 | 18.2 | 5.5 | 17.9 | 36.8 | 21.1 | 0.6 | 3.1 |
| 2738-8 | 17.9 | 4.5 | 14.8 | 42.2 | 20.2 | 0.4 | 3.0 |
| 2738-15 | 17.9 | 6.3 | 18.8 | 38.6 | 18.1 | 0.3 | 1.6 |
| 2738-30 | 19.3 | 5.6 | 15.6 | 42.7 | 16.7 | 0.2 | 1.1 |
| 2738-25 | 17.9 | 5.1 | 15.1 | 41.1 | 20.6 | 0.1 | 0.9 |
| 2738-1 | 18.1 | 5.3 | 16.0 | 41.3 | 19.4 | 0.0 | 0.0 |
| 2738-2 | 16.5 | 5.1 | 18.5 | 46.1 | 13.9 | 0.0 | 0.0 |
| 2738-3 | 17.6 | 5.4 | 18.2 | 40.0 | 18.8 | 0.0 | 0.0 |
| 2738-4 | 18.9 | 4.8 | 12.2 | 42.2 | 21.9 | 0.0 | 0.0 |
| 2738-5 | 18.1 | 4.0 | 14.9 | 48.9 | 14.2 | 0.0 | 0.0 |
| 2738-9 | 17.2 | 6.8 | 22.6 | 36.7 | 16.6 | 0.0 | 0.0 |
| 2738-11 | 18.3 | 5.4 | 16.5 | 39.0 | 20.8 | 0.0 | 0.0 |
| 2738-13 | 16.7 | 4.9 | 18.2 | 42.8 | 17.5 | 0.0 | 0.0 |
| 2738-14 | 16.5 | 5.9 | 19.1 | 41.7 | 16.7 | 0.0 | 0.0 |
| 2738-16 | 14.6 | 6.3 | 19.6 | 42.5 | 17.0 | 0.0 | 0.0 |
| 2738-17 | 17.0 | 4.9 | 14.8 | 40.8 | 22.5 | 0.0 | 0.0 |
| 2738-18 | 19.2 | 5.0 | 15.0 | 41.5 | 19.3 | 0.0 | 0.0 |
| 2738-19 | 16.8 | 5.8 | 19.5 | 41.6 | 16.3 | 0.0 | 0.0 |
| 2738-21 | 16.9 | 4.3 | 17.0 | 45.1 | 16.7 | 0.0 | 0.0 |
| 2738-22 | 16.3 | 5.3 | 19.1 | 41.7 | 17.6 | 0.0 | 0.0 |
| 2738-23 | 17.7 | 5.8 | 19.9 | 37.9 | 18.6 | 0.0 | 0.0 |
| 2738-24 | 17.0 | 5.6 | 18.7 | 42.7 | 16.2 | 0.0 | 0.0 |
| 2738-26 | 16.8 | 6.9 | 22.9 | 38.9 | 14.6 | 0.0 | 0.0 |
| 2738-27 | 16.3 | 5.5 | 17.8 | 41.2 | 19.2 | 0.0 | 0.0 |
| 2738-28 | 19.0 | 6.0 | 15.7 | 38.5 | 20.8 | 0.0 | 0.0 |
| 2738-29 | 17.5 | 4.6 | 16.5 | 43.6 | 17.8 | 0.0 | 0.0 |

TABLE 41-continued

Fatty Acid Analysis from Soy Somatic Embyros transformed with pKR1687 comprising RcHyd (MSE2738)
MSE2738 (RcHyd)

| Event # | 16:0 | 18:0 | 18:1 | 18:2 | 18:3 | Rcn | % Hydrox |
|---|---|---|---|---|---|---|---|
| Avg.* | 16.7 | 5.5 | 20.4 | 40.6 | 14.9 | 1.8 | 8.2 |
| Avg.** | 16.7 | 5.5 | 20.4 | 40.6 | 14.9 | 1.8 | 8.2 |

TABLE 42

Fatty Acid Analysis from Soy Somatic Embyros transformed with pKR1742 comprising RcHyd & CoMBOAT (MSE2742)
MSE2742 (RcHyd, CoMBOAT)

| Event # | 16:0 | 18:0 | 18:1 | 18:2 | 18:3 | Rcn | % Hydrox |
|---|---|---|---|---|---|---|---|
| 2742-14 | 18.2 | 7.3 | 21.4 | 28.6 | 13.6 | 10.9 | 33.7 |
| 2742-7 | 16.9 | 6.4 | 19.8 | 35.7 | 14.6 | 6.7 | 25.1 |
| 2742-24 | 16.8 | 6.8 | 22.9 | 33.5 | 15.6 | 4.4 | 16.0 |
| 2742-11 | 17.3 | 5.0 | 15.9 | 40.2 | 18.0 | 3.6 | 18.3 |
| 2742-27 | 17.9 | 6.8 | 24.0 | 30.2 | 17.8 | 3.4 | 12.4 |
| 2742-20 | 18.5 | 6.0 | 17.1 | 34.5 | 21.1 | 2.8 | 14.2 |
| 2742-18 | 17.8 | 6.2 | 19.7 | 35.2 | 18.6 | 2.5 | 11.1 |
| 2742-9 | 16.3 | 6.5 | 23.1 | 34.5 | 17.2 | 2.4 | 9.5 |
| 2742-13 | 17.5 | 5.8 | 17.2 | 36.5 | 21.2 | 1.7 | 9.2 |
| 2742-28 | 18.0 | 6.0 | 13.3 | 38.2 | 23.5 | 1.1 | 7.4 |
| 2742-15 | 17.1 | 5.5 | 18.1 | 37.2 | 21.0 | 0.9 | 4.9 |
| 2742-12 | 17.2 | 5.7 | 16.2 | 39.8 | 20.6 | 0.5 | 2.8 |
| 2742-1 | 18.3 | 5.2 | 15.0 | 42.4 | 19.1 | 0.0 | 0.0 |
| 2742-2 | 17.9 | 5.3 | 15.4 | 39.2 | 22.2 | 0.0 | 0.0 |
| 2742-3 | 17.1 | 4.5 | 11.0 | 39.3 | 28.1 | 0.0 | 0.0 |
| 2742-4 | 18.4 | 5.8 | 15.1 | 39.4 | 21.3 | 0.0 | 0.0 |
| 2742-5 | 19.3 | 5.3 | 14.0 | 39.5 | 22.0 | 0.0 | 0.0 |
| 2742-6 | 15.7 | 5.1 | 13.1 | 39.3 | 26.9 | 0.0 | 0.0 |
| 2742-8 | 17.8 | 5.4 | 16.2 | 36.2 | 24.5 | 0.0 | 0.0 |
| 2742-10 | 18.2 | 5.3 | 15.1 | 42.2 | 19.2 | 0.0 | 0.0 |
| 2742-16 | 18.6 | 5.2 | 16.4 | 38.0 | 21.8 | 0.0 | 0.0 |
| 2742-17 | 18.8 | 5.6 | 15.9 | 38.5 | 21.2 | 0.0 | 0.0 |
| 2742-19 | 17.9 | 5.6 | 16.7 | 39.5 | 20.2 | 0.0 | 0.0 |
| 2742-21 | 16.9 | 5.4 | 15.2 | 41.4 | 21.1 | 0.0 | 0.0 |
| 2742-22 | 17.7 | 5.6 | 15.8 | 39.9 | 21.0 | 0.0 | 0.0 |
| 2742-23 | 17.7 | 5.6 | 15.4 | 39.5 | 21.7 | 0.0 | 0.0 |
| 2742-25 | 17.6 | 5.4 | 16.8 | 40.2 | 19.9 | 0.0 | 0.0 |
| 2742-26 | 17.4 | 5.2 | 16.2 | 40.3 | 20.8 | 0.0 | 0.0 |
| 2742-29 | 18.3 | 5.2 | 14.8 | 41.4 | 20.3 | 0.0 | 0.0 |
| 2742-30 | 18.4 | 5.9 | 15.8 | 38.5 | 21.5 | 0.0 | 0.0 |
| Avg.* | 17.5 | 6.3 | 19.4 | 34.7 | 18.1 | 3.9 | 15.7 |
| Avg.** | 17.4 | 6.5 | 20.8 | 33.6 | 15.9 | 5.8 | 21.1 |

TABLE 43

Fatty Acid Analysis from Soy Somatic Embyros transformed with pKR1733 comprising RcHyd & CoDGAT2 (MSE2743)
MSE2743 (RcHyd, CoDGAT2)

| Event # | 16:0 | 18:0 | 18:1 | 18:2 | 18:3 | Rcn | % Hydrox |
|---|---|---|---|---|---|---|---|
| 2743-4 | 17.5 | 5.6 | 19.5 | 38.3 | 15.6 | 3.6 | 15.5 |
| 2743-18 | 16.1 | 6.6 | 24.7 | 37.3 | 13.1 | 2.2 | 8.0 |
| 2743-7 | 18.6 | 6.8 | 18.5 | 35.8 | 18.4 | 1.9 | 9.5 |
| 2743-28 | 16.7 | 7.1 | 28.1 | 34.2 | 12.1 | 1.9 | 6.3 |
| 2743-3 | 17.2 | 6.3 | 25.4 | 33.8 | 15.4 | 1.8 | 6.5 |
| 2743-29 | 18.0 | 6.4 | 21.9 | 36.0 | 16.1 | 1.6 | 6.7 |
| 2743-23 | 17.5 | 7.9 | 20.3 | 37.5 | 15.8 | 1.1 | 5.2 |
| 2743-22 | 18.8 | 6.2 | 14.6 | 40.5 | 19.0 | 0.9 | 5.8 |
| 2743-16 | 18.7 | 5.8 | 15.1 | 39.1 | 20.6 | 0.7 | 4.5 |
| 2743-12 | 17.9 | 5.8 | 18.6 | 40.6 | 16.4 | 0.6 | 3.3 |
| 2743-27 | 17.3 | 7.0 | 20.6 | 38.4 | 16.2 | 0.6 | 2.6 |
| 2743-21 | 18.1 | 6.4 | 19.5 | 38.0 | 17.5 | 0.6 | 2.8 |
| 2743-24 | 18.5 | 4.9 | 12.2 | 41.3 | 22.6 | 0.5 | 4.0 |
| 2743-11 | 17.4 | 7.7 | 24.0 | 35.8 | 14.6 | 0.5 | 2.0 |
| 2743-25 | 16.4 | 6.0 | 19.1 | 43.4 | 14.6 | 0.5 | 2.4 |
| 2743-13 | 17.6 | 5.3 | 16.1 | 39.8 | 20.7 | 0.5 | 2.8 |
| 2743-1 | 17.6 | 5.7 | 18.0 | 38.4 | 20.3 | 0.0 | 0.0 |
| 2743-2 | 17.6 | 6.0 | 20.0 | 40.0 | 16.4 | 0.0 | 0.0 |
| 2743-5 | 17.5 | 6.2 | 18.9 | 38.2 | 19.3 | 0.0 | 0.0 |
| 2743-6 | 17.2 | 5.7 | 17.9 | 43.3 | 15.9 | 0.0 | 0.0 |
| 2743-8 | 17.8 | 6.4 | 18.7 | 39.4 | 17.6 | 0.0 | 0.0 |
| 2743-9 | 18.4 | 5.7 | 18.8 | 40.9 | 16.2 | 0.0 | 0.0 |
| 2743-10 | 18.2 | 6.7 | 18.2 | 37.9 | 19.1 | 0.0 | 0.0 |
| 2743-14 | 18.3 | 7.2 | 20.3 | 38.8 | 15.3 | 0.0 | 0.0 |
| 2743-15 | 18.3 | 5.3 | 14.6 | 40.3 | 21.5 | 0.0 | 0.0 |
| 2743-17 | 16.5 | 5.9 | 22.3 | 44.0 | 11.3 | 0.0 | 0.0 |
| 2743-19 | 17.5 | 6.6 | 22.8 | 37.1 | 16.0 | 0.0 | 0.0 |
| 2743-20 | 17.2 | 5.4 | 16.5 | 40.8 | 20.0 | 0.0 | 0.0 |
| 2743-26 | 16.8 | 6.5 | 21.7 | 39.6 | 15.4 | 0.0 | 0.0 |
| Avg.* | 17.4 | 6.7 | 22.6 | 36.1 | 15.2 | 2.0 | 8.2 |
| Avg.** | 17.2 | 6.5 | 23.2 | 35.9 | 14.9 | 2.3 | 9.2 |

TABLE 44

Fatty Acid Analysis from Soy Somatic Embyros transformed with pKR1745 comprising RcHyd, CoMBOAT & CoDGAT2 (MSE2744)
MSE2744 (RcHyd, CoMBOAT, CoDGAT2)

| Event # | 16:0 | 18:0 | 18:1 | 18:2 | 18:3 | Rcn | % Hydrox |
|---|---|---|---|---|---|---|---|
| 2744-19 | 17.8 | 5.9 | 19.1 | 34.1 | 18.7 | 4.4 | 18.6 |
| 2744-25 | 17.0 | 6.8 | 23.0 | 33.1 | 16.0 | 4.1 | 15.2 |
| 2744-30 | 18.3 | 5.4 | 15.6 | 34.3 | 23.1 | 3.4 | 17.9 |
| 2744-26 | 17.2 | 6.3 | 19.0 | 36.2 | 18.5 | 2.8 | 12.8 |
| 2744-4 | 17.4 | 5.7 | 17.5 | 36.3 | 21.0 | 2.1 | 10.5 |
| 2744-28 | 17.0 | 6.0 | 20.7 | 35.0 | 19.2 | 2.0 | 8.9 |
| 2744-13 | 15.6 | 5.2 | 19.1 | 33.8 | 24.4 | 1.9 | 8.9 |
| 2744-17 | 17.1 | 5.0 | 19.2 | 36.7 | 20.2 | 1.7 | 8.2 |
| 2744-21 | 17.3 | 5.0 | 13.6 | 38.4 | 24.3 | 1.4 | 9.5 |
| 2744-3 | 16.7 | 5.5 | 18.3 | 38.1 | 20.0 | 1.4 | 7.1 |
| 2744-11 | 17.1 | 5.5 | 13.6 | 40.3 | 22.9 | 0.7 | 4.7 |
| 2744-24 | 16.6 | 5.4 | 16.8 | 35.9 | 24.5 | 0.6 | 3.6 |
| 2744-22 | 17.1 | 5.8 | 16.8 | 39.6 | 20.1 | 0.6 | 3.4 |
| 2744-12 | 17.4 | 5.8 | 15.7 | 40.0 | 20.6 | 0.5 | 3.2 |
| 2744-1 | 15.7 | 5.6 | 16.9 | 38.9 | 22.9 | 0.0 | 0.0 |
| 2744-2 | 17.5 | 5.1 | 15.6 | 41.4 | 20.4 | 0.0 | 0.0 |
| 2744-5 | 17.4 | 6.8 | 20.3 | 36.0 | 19.5 | 0.0 | 0.0 |
| 2744-6 | 17.9 | 5.6 | 15.0 | 41.5 | 20.0 | 0.0 | 0.0 |
| 2744-7 | 17.3 | 7.6 | 19.3 | 36.3 | 19.5 | 0.0 | 0.0 |
| 2744-8 | 18.0 | 6.9 | 18.3 | 35.8 | 21.0 | 0.0 | 0.0 |
| 2744-9 | 17.7 | 7.2 | 16.4 | 36.9 | 21.8 | 0.0 | 0.0 |
| 2744-10 | 18.5 | 5.7 | 14.9 | 37.9 | 23.1 | 0.0 | 0.0 |
| 2744-14 | 17.3 | 5.3 | 16.6 | 39.4 | 21.3 | 0.0 | 0.0 |
| 2744-15 | 17.8 | 5.5 | 16.3 | 38.7 | 21.7 | 0.0 | 0.0 |
| 2744-16 | 17.0 | 5.3 | 16.1 | 42.3 | 19.3 | 0.0 | 0.0 |
| 2744-18 | 17.1 | 6.0 | 15.4 | 37.6 | 23.9 | 0.0 | 0.0 |
| 2744-20 | 17.4 | 5.1 | 13.8 | 39.4 | 24.3 | 0.0 | 0.0 |
| 2744-23 | 18.1 | 5.2 | 16.1 | 38.2 | 22.6 | 0.0 | 0.0 |
| 2744-27 | 17.7 | 5.3 | 17.3 | 38.1 | 21.5 | 0.0 | 0.0 |
| 2744-29 | 17.6 | 5.9 | 18.8 | 36.9 | 20.9 | 0.0 | 0.0 |
| Avg.* | 17.2 | 5.7 | 18.5 | 35.6 | 20.5 | 2.5 | 11.8 |
| Avg.** | 17.5 | 6.0 | 18.9 | 34.8 | 19.4 | 3.4 | 15.0 |

TABLE 45

Fatty Acid Analysis from Soy Somatic Embyros transformed with pKR1743 comprising RcHyd & McMBOAT (MSE2739)
MSE2739 (RcHyd, McMBOAT)

| Event # | 16:0 | 18:0 | 18:1 | 18:2 | 18:3 | Rcn | % Hydrox |
|---|---|---|---|---|---|---|---|
| 2739-18 | 15.0 | 6.4 | 24.7 | 35.4 | 10.8 | 7.7 | 23.7 |
| 2739-5 | 18.1 | 6.8 | 21.7 | 31.7 | 14.0 | 7.7 | 26.1 |
| 2739-32 | 18.4 | 7.9 | 22.1 | 31.6 | 12.4 | 7.6 | 25.6 |
| 2739-15 | 16.4 | 5.0 | 20.7 | 39.2 | 13.0 | 5.6 | 21.4 |
| 2739-28 | 17.8 | 5.4 | 18.6 | 40.0 | 13.3 | 5.1 | 21.6 |
| 2739-11 | 18.2 | 6.1 | 20.0 | 37.5 | 14.1 | 4.1 | 17.1 |
| 2739-6 | 15.7 | 6.1 | 23.2 | 37.3 | 14.0 | 3.7 | 13.8 |
| 2739-27 | 15.4 | 7.4 | 26.7 | 35.4 | 11.4 | 3.7 | 12.2 |
| 2739-22 | 15.9 | 6.0 | 25.9 | 34.2 | 14.6 | 3.4 | 11.5 |
| 2739-13 | 15.2 | 6.8 | 26.7 | 35.6 | 12.6 | 3.0 | 10.0 |
| 2739-24 | 17.2 | 5.9 | 27.3 | 31.1 | 15.5 | 3.0 | 9.8 |

TABLE 45-continued

Fatty Acid Analysis from Soy Somatic Embyros transformed with pKR1743 comprising RcHyd & McMBOAT (MSE2739)
MSE2739 (RcHyd, McMBOAT)

| Event # | 16:0 | 18:0 | 18:1 | 18:2 | 18:3 | Rcn | % Hydrox |
|---|---|---|---|---|---|---|---|
| 2739-9 | 15.7 | 6.3 | 26.8 | 34.8 | 14.0 | 2.4 | 8.3 |
| 2739-8 | 16.8 | 5.1 | 25.7 | 33.2 | 17.1 | 2.2 | 8.0 |
| 2739-29 | 16.6 | 6.2 | 23.9 | 35.7 | 15.5 | 2.1 | 8.2 |
| 2739-1 | 15.9 | 5.2 | 20.2 | 41.0 | 15.6 | 2.1 | 9.4 |
| 2739-17 | 16.9 | 5.7 | 19.7 | 42.8 | 13.7 | 1.2 | 5.7 |
| 2739-3 | 15.3 | 5.0 | 25.0 | 40.3 | 13.1 | 1.2 | 4.5 |
| 2739-25 | 16.1 | 5.3 | 15.9 | 43.0 | 19.4 | 0.4 | 2.4 |
| 2739-4 | 16.8 | 4.3 | 14.2 | 50.3 | 14.1 | 0.3 | 2.0 |
| 2739-10 | 16.0 | 6.0 | 20.9 | 40.8 | 16.1 | 0.1 | 0.7 |
| 2739-16 | 17.1 | 5.8 | 17.3 | 42.4 | 17.3 | 0.1 | 0.6 |
| 2739-31 | 16.8 | 4.2 | 14.1 | 50.9 | 14.0 | 0.1 | 0.6 |
| 2739-2 | 16.9 | 5.3 | 16.6 | 40.9 | 20.3 | 0.0 | 0.0 |
| 2739-7 | 17.9 | 5.7 | 14.6 | 43.7 | 18.0 | 0.0 | 0.0 |
| 2739-12 | 16.5 | 6.4 | 21.3 | 39.7 | 16.1 | 0.0 | 0.0 |
| 2739-14 | 16.4 | 5.1 | 14.2 | 43.0 | 21.2 | 0.0 | 0.0 |
| 2739-19 | 16.8 | 5.9 | 16.8 | 40.5 | 20.0 | 0.0 | 0.0 |
| 2739-20 | 16.5 | 5.8 | 17.5 | 40.0 | 20.2 | 0.0 | 0.0 |
| 2739-21 | 18.4 | 4.2 | 13.7 | 41.3 | 22.4 | 0.0 | 0.0 |
| 2739-23 | 19.2 | 4.6 | 13.1 | 42.5 | 20.6 | 0.0 | 0.0 |
| 2739-26 | 18.1 | 5.6 | 15.3 | 39.3 | 21.8 | 0.0 | 0.0 |
| 2739-30 | 16.2 | 5.7 | 17.5 | 44.1 | 16.5 | 0.0 | 0.0 |
| Avg.* | 16.5 | 6.1 | 23.5 | 36.3 | 13.8 | 3.9 | 13.9 |
| Avg.** | 17.1 | 6.3 | 21.6 | 35.6 | 12.7 | 6.7 | 23.7 |

TABLE 46

Fatty Acid Analysis from Soy Somatic Embyros transformed with pKR1734 comprising RcHyd & McDGAT2 (MSE2740)
MSE2740 (RcHyd, McDGAT2)

| Event # | 16:0 | 18:0 | 18:1 | 18:2 | 18:3 | Rcn | % Hydrox |
|---|---|---|---|---|---|---|---|
| 2740-1 | 15.6 | 8.7 | 32.2 | 28.4 | 9.5 | 5.7 | 15.1 |
| 2740-2 | 14.6 | 7.3 | 35.0 | 29.5 | 8.7 | 4.9 | 12.4 |
| 2740-3 | 15.2 | 6.7 | 30.1 | 31.7 | 12.1 | 4.3 | 12.5 |
| 2740-30 | 15.2 | 8.2 | 34.3 | 29.1 | 9.3 | 3.8 | 10.0 |
| 2740-17 | 16.8 | 6.6 | 28.0 | 32.2 | 13.9 | 2.5 | 8.1 |
| 2740-10 | 16.7 | 4.9 | 19.9 | 42.6 | 14.5 | 1.5 | 6.9 |
| 2740-13 | 17.5 | 6.0 | 20.0 | 37.0 | 18.1 | 1.4 | 6.5 |
| 2740-21 | 17.1 | 5.8 | 22.6 | 37.3 | 16.3 | 1.0 | 4.1 |
| 2740-6 | 15.9 | 6.6 | 23.5 | 39.7 | 13.4 | 0.9 | 3.7 |
| 2740-25 | 16.6 | 5.7 | 25.2 | 37.5 | 14.1 | 0.9 | 3.3 |
| 2740-7 | 16.8 | 5.3 | 16.1 | 40.2 | 21.2 | 0.4 | 2.6 |
| 2740-4 | 16.4 | 5.9 | 17.1 | 45.9 | 14.4 | 0.2 | 1.4 |
| 2740-18 | 16.7 | 5.2 | 20.6 | 44.1 | 13.2 | 0.2 | 0.9 |
| 2740-5 | 17.7 | 5.4 | 17.6 | 43.6 | 15.7 | 0.0 | 0.0 |
| 2740-8 | 15.4 | 6.2 | 20.5 | 43.4 | 14.5 | 0.0 | 0.0 |
| 2740-9 | 15.8 | 4.9 | 16.1 | 47.1 | 16.1 | 0.0 | 0.0 |
| 2740-11 | 16.0 | 4.8 | 15.0 | 43.5 | 20.7 | 0.0 | 0.0 |

TABLE 46-continued

Fatty Acid Analysis from Soy Somatic Embyros transformed with pKR1734 comprising RcHyd & McDGAT2 (MSE2740)
MSE2740 (RcHyd, McDGAT2)

| Event # | 16:0 | 18:0 | 18:1 | 18:2 | 18:3 | Rcn | % Hydrox |
|---|---|---|---|---|---|---|---|
| 2740-12 | 16.5 | 6.3 | 21.2 | 41.9 | 14.2 | 0.0 | 0.0 |
| 2740-14 | 16.4 | 4.9 | 24.3 | 36.3 | 18.1 | 0.0 | 0.0 |
| 2740-15 | 15.9 | 6.1 | 26.2 | 37.4 | 14.4 | 0.0 | 0.0 |
| 2740-16 | 15.6 | 7.2 | 22.4 | 38.9 | 15.9 | 0.0 | 0.0 |
| 2740-19 | 16.8 | 4.8 | 13.0 | 42.2 | 23.3 | 0.0 | 0.0 |
| 2740-20 | 15.8 | 4.7 | 20.1 | 47.4 | 11.9 | 0.0 | 0.0 |
| 2740-22 | 15.8 | 4.6 | 20.7 | 46.0 | 12.9 | 0.0 | 0.0 |
| 2740-23 | 18.6 | 5.2 | 18.7 | 42.8 | 14.8 | 0.0 | 0.0 |
| 2740-24 | 15.8 | 5.7 | 16.7 | 44.3 | 17.5 | 0.0 | 0.0 |
| 2740-26 | 15.7 | 5.9 | 20.8 | 45.2 | 12.4 | 0.0 | 0.0 |
| 2740-27 | 17.2 | 6.7 | 22.9 | 39.4 | 13.9 | 0.0 | 0.0 |
| 2740-28 | 14.8 | 6.5 | 24.0 | 42.5 | 12.1 | 0.0 | 0.0 |
| 2740-29 | 17.0 | 5.1 | 15.6 | 45.7 | 16.5 | 0.0 | 0.0 |
| 2740-31 | 17.0 | 5.0 | 15.5 | 42.2 | 20.4 | 0.0 | 0.0 |
| Avg.* | 16.1 | 6.8 | 27.8 | 33.5 | 12.8 | 3.1 | 9.4 |
| Avg.** | 15.5 | 7.5 | 31.9 | 30.2 | 10.7 | 4.2 | 11.6 |

TABLE 47

Fatty Acid Analysis from Soy Somatic Embyros transformed with pKR1746 comprising RcHyd, McMBOAT & McDGAT2 (MSE2741)
MSE2741 (RcHyd, McMBOAT, McDGAT2)

| Event # | 16:0 | 18:0 | 18:1 | 18:2 | 18:3 | Rcn | % Hydrox |
|---|---|---|---|---|---|---|---|
| 2741-14 | 15.7 | 7.8 | 29.6 | 31.7 | 10.8 | 4.5 | 13.2 |
| 2741-30 | 16.6 | 7.1 | 28.7 | 33.2 | 10.8 | 3.6 | 11.1 |
| 2741-1 | 16.2 | 6.3 | 25.7 | 37.0 | 11.3 | 3.5 | 12.1 |
| 2741-10 | 17.0 | 6.9 | 26.2 | 34.1 | 14.1 | 1.7 | 6.1 |
| 2741-15 | 17.9 | 4.9 | 16.1 | 44.0 | 15.6 | 1.5 | 8.3 |
| 2741-5 | 16.8 | 5.9 | 21.0 | 36.7 | 18.5 | 1.1 | 4.9 |
| 2741-16 | 17.3 | 5.8 | 15.9 | 41.0 | 19.1 | 1.0 | 5.7 |
| 2741-6 | 16.2 | 5.3 | 15.1 | 44.0 | 18.8 | 0.5 | 3.3 |
| 2741-7 | 17.7 | 6.2 | 20.9 | 36.6 | 18.2 | 0.4 | 2.0 |
| 2741-8 | 16.4 | 5.7 | 18.9 | 43.3 | 15.4 | 0.3 | 1.5 |
| 2741-2 | 17.1 | 6.1 | 14.4 | 40.2 | 22.3 | 0.0 | 0.0 |
| 2741-3 | 18.3 | 6.0 | 17.6 | 38.5 | 19.6 | 0.0 | 0.0 |
| 2741-4 | 18.1 | 5.0 | 14.8 | 37.5 | 24.6 | 0.0 | 0.0 |
| 2741-9 | 17.7 | 5.7 | 15.2 | 40.8 | 20.5 | 0.0 | 0.0 |
| 2741-11 | 17.6 | 6.5 | 18.7 | 41.5 | 15.8 | 0.0 | 0.0 |
| 2741-12 | 17.6 | 6.0 | 17.2 | 41.7 | 17.4 | 0.0 | 0.0 |
| 2741-13 | 16.7 | 5.9 | 18.0 | 41.6 | 17.8 | 0.0 | 0.0 |
| 2741-17 | 18.2 | 5.8 | 18.3 | 41.8 | 15.9 | 0.0 | 0.0 |
| 2741-18 | 17.0 | 6.2 | 17.2 | 42.0 | 17.6 | 0.0 | 0.0 |
| 2741-19 | 14.9 | 7.0 | 21.0 | 43.2 | 14.0 | 0.0 | 0.0 |

TABLE 47-continued

Fatty Acid Analysis from Soy Somatic Embyros transformed with
pKR1746 comprising RcHyd, McMBOAT & McDGAT2 (MSE2741)
MSE2741 (RcHyd, McMBOAT, McDGAT2)

| Event # | 16:0 | 18:0 | 18:1 | 18:2 | 18:3 | Rcn | % Hydrox |
|---|---|---|---|---|---|---|---|
| 2741-20 | 17.7 | 5.2 | 15.5 | 40.0 | 21.6 | 0.0 | 0.0 |
| 2741-21 | 15.5 | 6.5 | 25.2 | 42.4 | 10.4 | 0.0 | 0.0 |
| 2741-22 | 16.9 | 6.3 | 21.2 | 39.6 | 16.0 | 0.0 | 0.0 |
| 2741-23 | 17.7 | 6.1 | 18.0 | 40.8 | 17.5 | 0.0 | 0.0 |
| 2741-24 | 18.3 | 6.3 | 18.5 | 37.5 | 19.3 | 0.0 | 0.0 |
| 2741-25 | 19.2 | 5.0 | 13.8 | 40.1 | 21.8 | 0.0 | 0.0 |
| 2741-26 | 17.4 | 6.6 | 20.4 | 39.9 | 15.7 | 0.0 | 0.0 |
| 2741-27 | 16.8 | 6.0 | 19.5 | 43.4 | 14.4 | 0.0 | 0.0 |
| 2741-28 | 16.2 | 6.6 | 23.8 | 40.5 | 12.8 | 0.0 | 0.0 |
| 2741-29 | 15.9 | 7.7 | 23.4 | 41.5 | 11.6 | 0.0 | 0.0 |
| 2741-31 | 17.7 | 4.6 | 15.3 | 49.3 | 13.2 | 0.0 | 0.0 |
| Avg.* | 16.8 | 6.4 | 23.3 | 36.8 | 14.3 | 2.4 | 8.8 |
| Avg.** | 16.7 | 6.6 | 25.3 | 36.0 | 12.5 | 3.0 | 10.2 |

A summary of the average fatty acid profiles for the five events having highest RCN content from each experiment (Avg. **) is shown in TABLE 48. In TABLE 48, the calculated % hydroxylation conversion efficiency (% Hydrox) to RCN is also shown for the average of the five events having highest RCN content from each experiment where the % Hydrox was calculated by dividing the sum of the average weight percent (wt. %) for RCN by the sum of the average wt. % for 18:1 and RCN and multiplying by 100 to express as a %. Also shown in TABLE 48 is the relative % hydroxylation (Rel % Hydrox) for each experiment where the % Hydrox for the experiment is divided by the % Hydrox for that of MSE2738 (RcHyd).

searches for similarity to sequences contained in the Soybean Genome Project, DoE Joint Genome Institute "Glyma1.01" gene set Specifically, the TBLASTN algorithm provided by National Center for Biotechnology Information (NCBI) was used with default parameters except the Filter Option was set to OFF.

In this way, two soy putative cDNA sequences were identified which encoded proteins with homology to the *Momordica* MBOAT protein (Glyma17g14070, called GmMBOAT1 and Glyma05g03510, called GmMBOAT2) were identified. The genomic sequences, coding sequences and corresponding amino acid sequences for GmMBOAT1 and GmMBOAT2 are set forth as SEQ ID NO:120, SEQ ID NO:121, SEQ ID NO:122, SEQ ID NO:123, SEQ ID NO:124 and SEQ ID NO:125, respectively.

GmMBOAT1 was PCR amplified from a soy cDNA library using oligonucleotides GmLPCAT1-5 (SEQ ID NO:126) and GmLPCAT1-3 (SEQ ID NO: 127) and Phusion polymerase according to the manufacturer's instructions. The resulting DNA fragment was cloned into Zero Blunt PCR Cloning Kit (Invitrogen Corporation), following the manufacturer's protocol, to produce pLF164 (SEQ ID NO:128).

GmMBOAT2 was PCR amplified in a similar way using oligonucleotides GmLPCAT2-5 (SEQ ID NO:129) and GmLPCAT1-3 (SEQ ID NO:127). The resulting DNA fragment was cloned into Zero Blunt PCR Cloning Kit (Invitrogen Corporation), following the manufacturer's protocol, to produce pLF165 (SEQ ID NO:130).

The NotI fragments of pLF164 (SEQ ID NO: 128) and pLF165 (SEQ ID NO:130), containing GmMBOAT1 and GmMBOAT2, respectively were cloned into the NotI site of pKR966 (SEQ ID NO:115), containing the soy KTi promoter, to produce pKR1813 (SEQ ID NO:131) and pKR1814 (SEQ ID NO:132), respectively.

The BsiWI fragments of pKR1813 (SEQ ID NO:131) and pKR1814 (SEQ ID NO:132), containing GmMBOAT1 and GmMBOAT2, respectively, were cloned into the BsiWI site of pKR1687 (SEQ ID NO:111) to produce pKR1821 (SEQ ID NO:133) and pKR1822 (SEQ ID NO:134), respectively.

TABLE 48

Comparing average fatty acid profiles for MBOAT and/or DGAT2 co-
expressed with a Castor Hydroxylase in Soy Somatic Embryos
Summary for top 5 events (RcHyd in Soy Somatic Embryos)

| Experiment | 16:0 | 18:0 | 18:1 | 18:2 | 18:3 | Rcn | % Hydrox | Rel % Hydrox |
|---|---|---|---|---|---|---|---|---|
| MSE2738 (RcHyd)* | 16.7 | 5.5 | 20.4 | 40.6 | 14.9 | 1.8 | 8.2 | 1.00 |
| MSE2739 (RcHyd, McMBOAT) | 17.1 | 6.3 | 21.6 | 35.6 | 12.7 | 6.7 | 23.7 | 2.88 |
| MSE2740 (RcHyd, McDGAT2) | 15.5 | 7.5 | 31.9 | 30.2 | 10.7 | 4.2 | 11.6 | 1.41 |
| MSE2741 (RcHyd, McDGAT2, McMBOAT) | 16.7 | 6.6 | 25.3 | 36.0 | 12.5 | 3.0 | 10.2 | 1.24 |
| MSE2742 (RcHyd, CoMBOAT) | 17.4 | 6.5 | 20.8 | 33.6 | 15.9 | 5.8 | 21.1 | 2.57 |
| MSE2743 (RcHyd, CoDGAT2) | 17.2 | 6.5 | 23.2 | 35.9 | 14.9 | 2.3 | 9.2 | 1.12 |
| MSE2744 (RcHyd, CoDGAT2, CoMBOAT) | 17.5 | 6.0 | 18.9 | 34.8 | 19.4 | 3.4 | 15.0 | 1.83 |

Example 20

Construction of Soybean Expression Vectors for Co-Expressing *Ricinus communis* Hydroxylase (RcHyd) with GmMBOAT1, GmMBOAT2 or EuphMBOAT Identifying and Cloning MBOAT Homologs from Soy Soybean homologs of the *Momordica* MBOAT gene were identified by conducting BLAST (Basic Local Alignment Search Tool; Altschul et al., J. Mol. Biol. 215:403 410 (1993))

Identifying and Cloning an MBOAT Homolog from *Euphorbia*

A cDNA library representing mRNAs from developing seeds of *Euphorbia lagascae* was prepared, and insert cDNA fragments were sequenced as previously described in Published US Patent Application No. US20040139499 and Cahoon et al. [Transgenic Production of Epoxy Fatty Acids by Expression of a Cytochrome P450 Enzyme from *Euphorbia lagascae* Seed. (2002) Plant Physiology, Vol. 123, pages 615-624]. cDNAs clones encoding *Euphorbia* lagascae membrane bound o-acyltransferase (MBOAT) homologs were identified by conducting BLAST (Basic Local Alignment Search Tool; Altschul et al., J. Mol. Biol. 215:403 410 (1993)) searches for similarity to sequences contained in the BLAST "nr" database (comprising all non-redundant GenBank CDS translations, sequences derived from the 3-dimensional structure Brookhaven Protein Data Bank, the last major release of the SWISS PROT protein sequence database, EMBL and DDBJ databases). All cDNA sequences from either library were analyzed for similarity to all publicly available DNA sequences contained in the "nr" database using the BLASTN algorithm provided by the National Center for Biotechnology Information (NCBI). The DNA sequences were translated in all reading frames and compared for similarity to all publicly available protein sequences contained in the "nr" database using the BLASTX algorithm (Gish and States, Nat. Genet. 3:266 272 (1993)) provided by the NCBI. For convenience, the P value (probability) of observing a match of a cDNA sequence to a sequence contained in the searched databases merely by chance as calculated by BLAST are reported herein as "pLog" values, which represent the negative of the logarithm of the reported P value. Accordingly, the greater the pLog value, the greater the likelihood that the cDNA sequence and the BLAST "hit" represent homologous proteins.

The BLASTX search using the nucleotide sequence from *Euphorbia lagascae* cDNA clone eel1c.pk002.h9 revealed similarity of the protein encoded by the cDNA to a hypothetical protein from *Ricinus communis* (Accession No. XP_002282807 (GI:225426775)) and to o-acyltransferase (membrane bound) domain containing protein, putative from *Ricinus communis* (Accession No. XP_002509709 (GI: 255537285)). The sequence of the entire *Euphorbia* lagascae cDNA insert in clone eel1c.pk002.h9 was determined and set forth in SEQ ID NO:135. The corresponding sequence for the coding sequence (CDS) and deduced amino acid sequences are set forth in SEQ ID NO:136 and SEQ ID NO:137.

The *Euphorbia* MBOAT homolog (EuphMBOAT) was PCR amplified from EST eel1c.pk002.h9 using oligonucleotides EIMBOAT-5Not (SEQ ID NO:138) and oEU mb-2 (SEQ ID NO:139) and Phusion polymerase according to the manufacturer's instructions. The resulting DNA fragment was cloned into Zero Blunt PCR Cloning Kit (Invitrogen Corporation), following the manufacturer's protocol, to produce pKR1823 (SEQ ID NO:140).

The NotI fragment of pKR1823 (SEQ ID NO:140), containing EuphMBOAT, was cloned into the NotI site of pKR966 (SEQ ID NO:115), containing the soy KTi promoter, to produce pKR1827 (SEQ ID NO:141).

The BsiWI fragment of pKR1827 (SEQ ID NO:141), containing EuphMBOAT was cloned into the BsiWI site of pKR1687 (SEQ ID NO:111) to produce pKR1836 (SEQ ID NO:142).

Example 21

Co-Expressing RcHyd with GmMBOAT1, GmMBOAT2 or EuphMBOAT in Soy Somatic Embryos

Soybean expression vectors pKR1687 (SEQ ID NO:111), comprising RcHyd, pKR1821(SEQ ID NO:133), comprising RcHyd and GmMBOAT1, pKR1822 (SEQ ID NO:134), comprising RcHyd and GmMBOAT2 and pKR1836 (SEQ ID NO:142), comprising RcHyd and EuphMBOAT were transformed into soy, and lipid fatty acid profiles and oil contents were analyzed as described within.

Fatty acid profiles for approximately 30 events from each transformation are summarized in TABLEs 49, 50, 51, and 52, respectively.

In the Tables, the fatty acid profiles as a weight percent of total fatty acids are shown where 16:0 is palmitic acid, 18:0 is stearic acid, 18:1 is oleic acid, 18:2 is linoleic acid, 18:3 is alpha-linolenic acid and Rcn is ricinoleic acid. Results for each event are sorted according to RCN concentrations in decreasing order. The average fatty acid profiles for the five events having highest RCN content from each experiment are also shown in each table (Avg. **) where only events having eleostearic acid greater than 1% are included in the average calculation.

TABLE 49

Fatty Acid Analysis from Soy Somatic Embyros transformed with pKR1687 comprising RcHyd (MSE2762)
MSE2762 (RcHyd)

| Event # | 16:0 | 18:0 | 18:1 | 18:2 | 18:3 | Rcn | % Hydrox |
|---|---|---|---|---|---|---|---|
| 2762-19 | 14.1 | 7.5 | 35.7 | 30.1 | 8.2 | 4.4 | 11.0 |
| 2762-26 | 14.3 | 8.0 | 41.5 | 25.1 | 8.8 | 2.4 | 5.5 |
| 2762-13 | 15.7 | 8.6 | 23.6 | 35.4 | 14.6 | 2.2 | 8.5 |
| 2762-29 | 14.4 | 11.4 | 31.5 | 30.7 | 9.8 | 2.2 | 6.4 |
| 2762-17 | 17.3 | 5.4 | 20.7 | 37.5 | 17.9 | 1.2 | 5.3 |
| 2762-23 | 16.0 | 6.1 | 29.7 | 34.9 | 12.1 | 1.2 | 3.8 |
| 2762-18 | 16.4 | 5.7 | 22.9 | 39.3 | 14.8 | 0.9 | 3.7 |
| 2762-8 | 15.8 | 8.6 | 30.5 | 33.4 | 11.0 | 0.8 | 2.4 |
| 2762-10 | 15.4 | 7.6 | 34.0 | 31.7 | 10.8 | 0.5 | 1.4 |
| 2762-28 | 14.8 | 8.3 | 21.8 | 42.9 | 11.8 | 0.4 | 1.6 |
| 2762-4 | 17.1 | 6.0 | 24.2 | 38.6 | 14.0 | 0.1 | 0.5 |
| 2762-2 | 15.7 | 6.9 | 28.2 | 35.7 | 13.4 | 0.1 | 0.4 |
| 2762-24 | 14.9 | 9.0 | 38.4 | 27.3 | 10.3 | 0.1 | 0.3 |
| 2762-1 | 16.9 | 4.9 | 18.6 | 39.1 | 20.5 | 0.0 | 0.0 |
| 2762-3 | 15.6 | 6.7 | 23.1 | 38.0 | 16.5 | 0.0 | 0.0 |
| 2762-5 | 15.1 | 7.9 | 29.5 | 36.4 | 11.1 | 0.0 | 0.0 |
| 2762-6 | 15.7 | 7.2 | 29.5 | 35.4 | 12.1 | 0.0 | 0.0 |
| 2762-7 | 15.4 | 8.6 | 20.6 | 41.0 | 14.4 | 0.0 | 0.0 |
| 2762-9 | 16.5 | 6.6 | 26.3 | 36.2 | 14.4 | 0.0 | 0.0 |
| 2762-11 | 16.3 | 6.5 | 26.2 | 35.8 | 15.2 | 0.0 | 0.0 |
| 2762-12 | 15.0 | 8.0 | 35.1 | 30.5 | 11.4 | 0.0 | 0.0 |
| 2762-14 | 16.5 | 6.3 | 25.3 | 36.0 | 15.8 | 0.0 | 0.0 |
| 2762-15 | 16.7 | 6.8 | 24.0 | 37.9 | 14.6 | 0.0 | 0.0 |
| 2762-16 | 18.4 | 6.5 | 25.4 | 35.4 | 14.3 | 0.0 | 0.0 |
| 2762-20 | 15.5 | 9.4 | 32.7 | 31.3 | 11.1 | 0.0 | 0.0 |
| 2762-21 | 16.9 | 5.1 | 18.5 | 42.0 | 17.5 | 0.0 | 0.0 |
| 2762-22 | 16.1 | 6.4 | 25.1 | 39.0 | 13.3 | 0.0 | 0.0 |
| 2762-25 | 16.9 | 5.6 | 20.4 | 38.5 | 18.5 | 0.0 | 0.0 |
| 2762-27 | 15.8 | 6.9 | 28.3 | 35.9 | 13.2 | 0.0 | 0.0 |
| 2762-30 | 16.7 | 5.5 | 22.9 | 39.5 | 15.4 | 0.0 | 0.0 |
| 2762-31 | 17.4 | 5.5 | 18.5 | 40.7 | 17.8 | 0.0 | 0.0 |
| Avg.* | 15.3 | 7.8 | 30.5 | 32.3 | 11.9 | 2.2 | 6.7 |
| Avg.** | 15.2 | 8.2 | 30.6 | 31.7 | 11.8 | 2.5 | 7.3 |

TABLE 50

Fatty Acid Analysis from Soy Somatic Embyros transformed with pKR1821 comprising RcHyd & GmMBOAT1 (MSE2764)
MSE2764 (RcHyd + GmMBOAT1)

| Event # | 16:0 | 18:0 | 18:1 | 18:2 | 18:3 | Rcn | % Hydrox |
|---|---|---|---|---|---|---|---|
| 2764-23 | 17.8 | 7.3 | 24.3 | 29.3 | 13.1 | 8.2 | 25.3 |
| 2764-29 | 13.9 | 8.0 | 36.2 | 25.2 | 9.6 | 7.1 | 16.4 |
| 2764-28 | 14.9 | 6.8 | 32.1 | 28.3 | 11.9 | 6.0 | 15.8 |
| 2764-2 | 15.2 | 6.9 | 34.1 | 28.9 | 12.5 | 2.5 | 6.8 |
| 2764-9 | 15.2 | 8.2 | 36.5 | 29.0 | 9.0 | 2.1 | 5.5 |
| 2764-6 | 15.8 | 7.2 | 30.1 | 33.7 | 11.5 | 1.7 | 5.4 |
| 2764-4 | 15.7 | 6.0 | 33.1 | 31.4 | 12.1 | 1.6 | 4.7 |
| 2764-24 | 15.1 | 7.2 | 26.2 | 39.4 | 11.2 | 0.8 | 3.1 |
| 2764-10 | 17.0 | 5.9 | 24.9 | 34.5 | 17.1 | 0.6 | 2.3 |
| 2764-5 | 16.5 | 6.9 | 27.1 | 36.9 | 12.1 | 0.3 | 1.1 |
| 2764-18 | 16.2 | 6.3 | 20.4 | 42.4 | 14.7 | 0.1 | 0.4 |
| 2764-1 | 16.3 | 7.5 | 29.0 | 35.1 | 12.1 | 0.0 | 0.0 |
| 2764-3 | 15.8 | 8.4 | 31.5 | 33.6 | 10.7 | 0.0 | 0.0 |
| 2764-7 | 17.7 | 5.9 | 18.0 | 38.0 | 20.4 | 0.0 | 0.0 |
| 2764-8 | 16.1 | 7.0 | 26.2 | 39.1 | 11.6 | 0.0 | 0.0 |
| 2764-11 | 16.6 | 6.4 | 20.7 | 39.6 | 16.8 | 0.0 | 0.0 |
| 2764-12 | 17.8 | 5.7 | 21.0 | 38.3 | 17.3 | 0.0 | 0.0 |
| 2764-13 | 16.5 | 7.1 | 27.1 | 35.9 | 13.3 | 0.0 | 0.0 |
| 2764-14 | 16.4 | 6.6 | 23.3 | 39.5 | 14.2 | 0.0 | 0.0 |
| 2764-15 | 16.3 | 7.1 | 26.4 | 37.1 | 13.1 | 0.0 | 0.0 |
| 2764-16 | 16.6 | 6.2 | 22.5 | 38.8 | 16.0 | 0.0 | 0.0 |
| 2764-17 | 15.8 | 7.7 | 30.6 | 33.4 | 12.5 | 0.0 | 0.0 |
| 2764-19 | 16.6 | 6.4 | 26.1 | 39.8 | 11.1 | 0.0 | 0.0 |
| 2764-20 | 15.9 | 6.9 | 33.3 | 32.0 | 12.0 | 0.0 | 0.0 |
| 2764-21 | 16.5 | 7.2 | 25.2 | 38.3 | 12.8 | 0.0 | 0.0 |
| 2764-22 | 16.1 | 6.9 | 25.3 | 38.5 | 13.1 | 0.0 | 0.0 |
| 2764-25 | 16.8 | 6.2 | 20.1 | 37.4 | 19.5 | 0.0 | 0.0 |
| 2764-26 | 15.7 | 7.7 | 30.2 | 35.0 | 11.4 | 0.0 | 0.0 |
| 2764-27 | 17.3 | 5.3 | 19.0 | 39.9 | 18.5 | 0.0 | 0.0 |
| 2764-30 | 18.1 | 5.1 | 16.2 | 35.0 | 25.5 | 0.0 | 0.0 |
| Avg.* | 15.5 | 7.2 | 32.3 | 29.4 | 11.4 | 4.2 | 11.4 |
| Avg.** | 15.4 | 7.4 | 32.6 | 28.1 | 11.2 | 5.2 | 14.0 |

TABLE 51

Fatty Acid Analysis from Soy Somatic Embyros transformed with pKR1822 comprising RcHyd & GmMBOAT2 (MSE2765)
MSE2765 (RcHyd + GmMBOAT2)

| Event # | 16:0 | 18:0 | 18:1 | 18:2 | 18:3 | Rcn | % Hydrox |
|---|---|---|---|---|---|---|---|
| 2765-6 | 19.7 | 5.6 | 17.1 | 32.4 | 16.6 | 8.5 | 33.3 |
| 2765-11 | 15.6 | 6.2 | 24.7 | 31.2 | 14.1 | 8.2 | 25.0 |
| 2765-18 | 17.9 | 5.9 | 22.9 | 31.8 | 15.1 | 6.3 | 21.7 |
| 2765-10 | 15.4 | 7.0 | 25.9 | 31.8 | 14.2 | 5.6 | 17.8 |
| 2765-31 | 15.4 | 6.3 | 28.3 | 30.6 | 14.0 | 5.3 | 15.9 |
| 2765-21 | 17.3 | 5.4 | 22.5 | 32.3 | 18.0 | 4.5 | 16.7 |
| 2765-14 | 17.3 | 5.3 | 17.6 | 36.7 | 20.4 | 2.6 | 12.8 |
| 2765-15 | 18.0 | 5.1 | 12.4 | 37.8 | 24.6 | 2.1 | 14.8 |
| 2765-17 | 16.4 | 5.2 | 19.9 | 37.8 | 18.6 | 2.1 | 9.5 |
| 2765-29 | 16.1 | 6.0 | 25.0 | 35.3 | 15.8 | 1.9 | 6.9 |
| 2765-30 | 17.2 | 5.1 | 18.8 | 37.3 | 20.1 | 1.5 | 7.6 |
| 2765-22 | 17.2 | 5.5 | 20.4 | 37.5 | 18.3 | 1.0 | 4.8 |
| 2765-23 | 16.9 | 4.8 | 18.3 | 39.3 | 20.1 | 0.6 | 2.9 |
| 2765-1 | 17.9 | 5.2 | 18.9 | 38.0 | 19.5 | 0.5 | 2.6 |
| 2765-16 | 18.5 | 5.3 | 15.6 | 36.6 | 23.4 | 0.5 | 3.1 |
| 2765-24 | 16.7 | 5.7 | 19.4 | 38.3 | 19.5 | 0.4 | 2.0 |
| 2765-4 | 17.8 | 4.8 | 17.6 | 40.5 | 18.9 | 0.4 | 2.2 |
| 2765-12 | 17.7 | 5.0 | 16.8 | 33.4 | 26.8 | 0.4 | 2.2 |
| 2765-5 | 16.1 | 4.7 | 12.4 | 40.8 | 25.8 | 0.2 | 1.7 |
| 2765-7 | 18.4 | 5.0 | 15.9 | 40.1 | 20.4 | 0.2 | 1.3 |
| 2765-20 | 16.7 | 4.8 | 15.5 | 41.2 | 21.8 | 0.1 | 0.5 |
| 2765-2 | 18.0 | 5.7 | 17.1 | 39.9 | 19.3 | 0.0 | 0.0 |
| 2765-3 | 16.8 | 4.9 | 17.8 | 40.7 | 19.8 | 0.0 | 0.0 |
| 2765-8 | 18.1 | 4.6 | 15.5 | 38.2 | 23.6 | 0.0 | 0.0 |
| 2765-9 | 17.3 | 5.4 | 19.3 | 39.3 | 18.6 | 0.0 | 0.0 |
| 2765-13 | 17.1 | 5.3 | 19.2 | 40.2 | 18.1 | 0.0 | 0.0 |
| 2765-19 | 18.3 | 5.2 | 15.5 | 35.4 | 25.6 | 0.0 | 0.0 |
| 2765-25 | 16.9 | 5.3 | 17.1 | 40.6 | 20.1 | 0.0 | 0.0 |
| 2765-26 | 17.2 | 5.8 | 18.7 | 39.6 | 18.8 | 0.0 | 0.0 |
| 2765-27 | 18.2 | 4.7 | 13.7 | 39.7 | 23.7 | 0.0 | 0.0 |
| 2765-28 | 16.3 | 4.8 | 14.2 | 42.0 | 22.7 | 0.0 | 0.0 |
| Avg.* | 17.0 | 5.7 | 21.3 | 34.4 | 17.5 | 4.2 | 15.6 |
| Avg.** | 16.8 | 6.2 | 23.8 | 31.6 | 14.8 | 6.8 | 22.7 |

TABLE 52

Fatty Acid Analysis from Soy Somatic Embyros transformed with pKR1836 comprising RcHyd & EuphMBOAT (MSE2767)
MSE2767 (RcHyd + EuphMBOAT)

| Event # | 16:0 | 18:0 | 18:1 | 18:2 | 18:3 | Rcn | % Hydrox |
|---|---|---|---|---|---|---|---|
| 2767-28 | 15.7 | 7.2 | 35.1 | 25.3 | 10.3 | 6.4 | 15.3 |
| 2767-17 | 16.4 | 6.7 | 27.5 | 33.3 | 11.6 | 4.6 | 14.2 |
| 2767-29 | 17.2 | 5.9 | 22.6 | 32.8 | 17.2 | 4.5 | 16.5 |
| 2767-8 | 17.8 | 5.1 | 18.9 | 35.6 | 18.7 | 3.9 | 17.2 |
| 2767-4 | 17.3 | 6.1 | 26.4 | 33.4 | 13.6 | 3.2 | 10.8 |
| 2767-9 | 15.9 | 7.1 | 32.2 | 31.0 | 11.5 | 2.3 | 6.6 |
| 2767-12 | 16.9 | 5.4 | 23.8 | 35.6 | 16.2 | 2.1 | 8.2 |
| 2767-24 | 16.8 | 6.3 | 27.6 | 33.9 | 13.4 | 2.0 | 6.7 |
| 2767-10 | 17.9 | 5.3 | 19.4 | 37.4 | 18.0 | 2.0 | 9.2 |
| 2767-3 | 17.5 | 6.7 | 25.3 | 34.8 | 13.8 | 1.9 | 6.8 |

TABLE 52-continued

Fatty Acid Analysis from Soy Somatic Embyros transformed with pKR1836 comprising RcHyd & EuphMBOAT (MSE2767)
MSE2767 (RcHyd + EuphMBOAT)

| Event # | 16:0 | 18:0 | 18:1 | 18:2 | 18:3 | Rcn | % Hydrox |
|---|---|---|---|---|---|---|---|
| 2767-2 | 16.7 | 6.1 | 26.9 | 35.1 | 13.7 | 1.6 | 5.6 |
| 2767-13 | 16.6 | 6.7 | 27.6 | 34.1 | 13.7 | 1.2 | 4.1 |
| 2767-21 | 17.2 | 6.2 | 22.7 | 36.8 | 16.0 | 1.0 | 4.3 |
| 2767-7 | 17.5 | 5.8 | 22.9 | 34.6 | 18.3 | 0.9 | 3.7 |
| 2767-27 | 16.7 | 6.3 | 31.3 | 31.7 | 13.2 | 0.7 | 2.2 |
| 2767-31 | 18.2 | 6.4 | 26.0 | 35.5 | 13.6 | 0.3 | 1.2 |
| 2767-1 | 18.0 | 4.6 | 16.3 | 39.4 | 21.5 | 0.2 | 1.4 |
| 2767-30 | 18.9 | 5.2 | 15.0 | 41.6 | 19.1 | 0.2 | 1.3 |
| 2767-15 | 17.9 | 6.0 | 19.2 | 39.5 | 17.3 | 0.1 | 0.5 |
| 2767-5 | 19.4 | 5.1 | 18.2 | 42.2 | 15.1 | 0.0 | 0.0 |
| 2767-6 | 17.3 | 5.4 | 16.1 | 41.6 | 19.6 | 0.0 | 0.0 |
| 2767-11 | 18.0 | 5.5 | 17.1 | 41.9 | 17.6 | 0.0 | 0.0 |
| 2767-14 | 18.3 | 4.9 | 15.0 | 39.7 | 22.1 | 0.0 | 0.0 |
| 2767-16 | 17.1 | 7.0 | 28.4 | 34.2 | 13.4 | 0.0 | 0.0 |
| 2767-18 | 18.0 | 5.3 | 22.7 | 33.8 | 20.3 | 0.0 | 0.0 |
| 2767-19 | 16.9 | 6.9 | 26.7 | 36.0 | 13.5 | 0.0 | 0.0 |
| 2767-20 | 17.6 | 5.1 | 17.4 | 40.4 | 19.6 | 0.0 | 0.0 |
| 2767-22 | 16.7 | 6.8 | 26.8 | 36.8 | 12.9 | 0.0 | 0.0 |
| 2767-23 | 18.2 | 5.5 | 17.7 | 40.3 | 18.2 | 0.0 | 0.0 |
| 2767-25 | 18.1 | 5.6 | 20.5 | 39.2 | 16.6 | 0.0 | 0.0 |
| 2767-26 | 18.2 | 5.6 | 20.4 | 37.7 | 18.0 | 0.0 | 0.0 |
| Avg.* | 17.2 | 6.1 | 24.6 | 34.8 | 15.3 | 2.0 | 7.2 |
| Avg.** | 16.9 | 6.2 | 26.1 | 32.1 | 14.3 | 4.5 | 14.8 |

A summary of the average fatty acid profiles for the five events having highest RCN content from each experiment (Avg. **) is shown in TABLE 53. In TABLE 53, the calculated % hydroxylation conversion efficiency (% Hydrox) to RCN is also shown for the average of the five events having highest RCN content from each experiment where the % Hydrox was calculated by dividing the sum of the average weight percent (wt. %) for RCN by the sum of the average wt. % for 18:1 and RCN and multiplying by 100 to express as a %. Also shown in TABLE 53 is the relative % hydroxylation (Rel % Hydrox) for each experiment where the % Hydrox for the experiment is divided by the % Hydrox for that of MSE2738 (RcHyd).

TABLE 53

Comparing average fatty acid profiles for MBOAT co-expressed with a Castor Hydroxylase in Soy Somatic Embryos
Summary for top 5 events (RcHyd in Soy Somatic Embryos)

| Experiment | 16:0 | 18:0 | 18:1 | 18:2 | 18:3 | Rcn | % Hyrox | Rel % Hydrox |
|---|---|---|---|---|---|---|---|---|
| MSE2762 (RcHyd) | 15.2 | 8.2 | 30.6 | 31.7 | 11.8 | 2.5 | 7.3 | 1.00 |
| MSE2764 (RcHyd, GmMBOAT1) | 15.4 | 7.4 | 32.6 | 28.1 | 11.2 | 5.2 | 14.0 | 1.91 |
| MSE2765 (RcHyd, GmMBOAT2) | 16.8 | 6.2 | 23.8 | 31.6 | 14.8 | 6.8 | 22.7 | 3.10 |
| MSE2767 (RcHyd, EuphMBOAT) | 16.9 | 6.2 | 26.1 | 32.1 | 14.3 | 4.5 | 14.8 | 2.02 |

Example 22

Construction of Soybean Expression Vectors for Co-Expressing *Euphorbia lagascae* Cytochorme P450 (EuphEpox) with EuphMBOAT and Co-Expressing in Soy Somatice Embryos Cloning EuphEpox and Construction of Co-Expression Vectors The NotI fragment of plasmid pKR31, containing the open-reading frame of the cDNA for EST eel1c.pk002.14 flanked by NotI sites (EuphEpox) and which was previously described in Published US Patent Application No. US20040139499 and Cahoon et al. [Transgenic Production of Epoxy Fatty Acids by Expression of a Cytochrome P450 Enzyme from *Euphorbia lagascae* Seed. (2002) Plant Physiology, Vol. 123, pages 615-624] was cloned into the NotI site of pKR72 to produce pKR1815 (SEQ ID NO:143). In pKR1815, EuphEpox is under control of the soy beta-conglycinin promoter. EuphEpox generates the epoxidated fatty acid (Vernolic acid) when expressed in soy.

The BsiWI fragment of pKR1827 (SEQ ID NO:141), containing EuphMBOAT, was cloned into the BsiWI site of pKR1815 (SEQ ID NO:143) to produce pKR1835 (SEQ ID NO:144).

Co-Expressing EuphEpox with EuphMBOAT in Soy Somatic Embryos

Soybean expression vectors pKR1815 (SEQ ID NO:143), comprising EuphEpox and pKR1835 (SEQ ID NO:144), comprising EuphEpox and EuphMBOAT, were transformed into soy and lipid fatty acid profiles and oil contents were analyzed as described within.

Fatty acid profiles for approximately 30 events from each transformation are summarized in TABLEs 54 and 55, respectively.

In the Tables, the fatty acid profiles as a weight percent of total fatty acids are shown where 16:0 is palmitic acid, 18:0 is stearic acid, 18:1 is oleic acid, 18:2 is linoleic acid, 18:3 is alpha-linolenic acid and VERN is Vernolic acid. Results for each event are sorted according to VERN concentrations in decreasing order. The average fatty acid profiles for the five events having highest VERN content from each experiment are also shown in each table (Avg. **).

TABLE 54

Fatty Acid Analysis from Soy Somatic Embyros transformed with pKR1815 comprising EuphEpox (MSE2763) MSE2763 (EuphP450)

| Event # | 16:0 | 18:0 | 18:1 | 18:2 | 18:3 | VERN | % Epox |
|---|---|---|---|---|---|---|---|
| 2763-5 | 16.7 | 4.7 | 18.3 | 38.6 | 21.2 | 0.5 | 1.3 |
| 2763-6 | 16.8 | 5.7 | 22.3 | 36.4 | 18.4 | 0.5 | 1.4 |
| 2763-1 | 16.9 | 5.6 | 20.1 | 37.2 | 19.8 | 0.4 | 1.1 |
| 2763-31 | 17.6 | 5.5 | 18.7 | 37.8 | 20.1 | 0.3 | 0.7 |
| 2763-10 | 16.4 | 4.3 | 13.6 | 37.7 | 27.7 | 0.3 | 0.7 |
| 2763-12 | 17.9 | 6.3 | 19.6 | 38.2 | 17.9 | 0.2 | 0.6 |
| 2763-29 | 17.6 | 5.7 | 22.0 | 37.8 | 16.7 | 0.2 | 0.6 |
| 2763-3 | 13.3 | 4.7 | 22.0 | 45.6 | 14.1 | 0.2 | 0.5 |
| 2763-30 | 17.9 | 5.0 | 14.5 | 38.9 | 23.4 | 0.2 | 0.5 |
| 2763-4 | 16.3 | 4.8 | 17.6 | 41.0 | 20.0 | 0.2 | 0.4 |
| 2763-25 | 17.2 | 5.2 | 15.5 | 38.6 | 23.4 | 0.1 | 0.4 |
| 2763-17 | 17.7 | 5.1 | 17.9 | 38.5 | 20.7 | 0.1 | 0.3 |
| 2763-8 | 17.5 | 5.0 | 18.5 | 40.1 | 18.8 | 0.1 | 0.3 |
| 2763-22 | 17.3 | 6.0 | 22.2 | 39.1 | 15.2 | 0.1 | 0.3 |
| 2763-13 | 17.1 | 4.9 | 16.3 | 39.7 | 21.8 | 0.1 | 0.2 |
| 2763-2 | 17.2 | 4.9 | 15.4 | 39.0 | 23.5 | 0.0 | 0.0 |
| 2763-7 | 16.0 | 5.7 | 15.4 | 39.2 | 23.8 | 0.0 | 0.0 |
| 2763-9 | 17.4 | 5.4 | 17.0 | 37.9 | 22.2 | 0.0 | 0.0 |
| 2763-11 | 16.5 | 5.1 | 17.6 | 39.9 | 20.8 | 0.0 | 0.0 |
| 2763-14 | 16.7 | 5.0 | 21.5 | 36.3 | 20.6 | 0.0 | 0.0 |
| 2763-15 | 17.5 | 5.4 | 19.5 | 39.4 | 18.1 | 0.0 | 0.0 |
| 2763-16 | 16.4 | 4.5 | 17.1 | 40.3 | 21.7 | 0.0 | 0.0 |
| 2763-18 | 19.0 | 5.2 | 13.6 | 40.9 | 21.3 | 0.0 | 0.0 |
| 2763-19 | 17.6 | 6.0 | 18.3 | 40.7 | 17.4 | 0.0 | 0.0 |
| 2763-20 | 18.0 | 5.4 | 17.3 | 40.3 | 19.1 | 0.0 | 0.0 |
| 2763-21 | 17.1 | 5.6 | 15.8 | 39.0 | 22.4 | 0.0 | 0.0 |
| 2763-23 | 14.9 | 4.9 | 20.0 | 45.0 | 15.2 | 0.0 | 0.0 |
| 2763-24 | 18.4 | 5.0 | 16.4 | 39.3 | 20.9 | 0.0 | 0.0 |
| 2763-26 | 17.4 | 4.5 | 14.6 | 40.5 | 23.0 | 0.0 | 0.0 |
| 2763-27 | 17.6 | 6.4 | 20.5 | 37.1 | 18.4 | 0.0 | 0.0 |
| 2763-28 | 18.1 | 5.5 | 16.7 | 38.0 | 21.7 | 0.0 | 0.0 |
| Avg.* | 16.7 | 5.2 | 18.9 | 38.9 | 19.9 | 0.3 | 0.9 |
| Avg.** | 16.9 | 5.2 | 18.6 | 37.6 | 21.4 | 0.4 | 1.0 |

TABLE 55

Fatty Acid Analysis from Soy Somatic Embyros transformed with pKR1835 comprising EuphEpox (MSE2766) MSE2766 (EuphP450 + EuphMBOAT)

| Event # | 16:0 | 18:0 | 18:1 | 18:2 | 18:3 | VERN | % Epox |
|---|---|---|---|---|---|---|---|
| 2766-11 | 15.0 | 6.3 | 31.2 | 35.7 | 9.9 | 1.8 | 4.9 |
| 2766-17 | 17.1 | 5.8 | 24.4 | 37.4 | 14.5 | 0.8 | 2.0 |
| 2766-12 | 15.5 | 7.2 | 22.2 | 41.3 | 13.2 | 0.6 | 1.4 |
| 2766-16 | 16.4 | 6.4 | 25.5 | 39.7 | 11.7 | 0.4 | 1.1 |
| 2766-15 | 17.8 | 6.3 | 23.5 | 36.0 | 16.0 | 0.4 | 1.1 |
| 2766-5 | 16.0 | 7.3 | 28.2 | 37.1 | 11.0 | 0.4 | 1.0 |
| 2766-27 | 17.0 | 6.2 | 23.5 | 39.7 | 13.3 | 0.4 | 1.0 |
| 2766-22 | 16.6 | 6.8 | 24.9 | 38.0 | 13.4 | 0.3 | 0.8 |
| 2766-19 | 17.7 | 5.3 | 18.5 | 39.6 | 18.7 | 0.3 | 0.7 |
| 2766-18 | 17.9 | 5.2 | 22.0 | 37.1 | 17.6 | 0.3 | 0.7 |
| 2766-4 | 17.9 | 6.4 | 23.2 | 38.0 | 14.2 | 0.3 | 0.7 |
| 2766-13 | 16.6 | 6.5 | 24.9 | 38.1 | 13.7 | 0.2 | 0.6 |
| 2766-30 | 16.8 | 6.2 | 21.3 | 41.7 | 13.8 | 0.2 | 0.6 |
| 2766-26 | 18.1 | 5.1 | 18.2 | 42.0 | 16.4 | 0.2 | 0.5 |
| 2766-1 | 16.8 | 7.0 | 22.1 | 39.0 | 14.9 | 0.2 | 0.5 |
| 2766-10 | 17.8 | 5.6 | 17.6 | 39.6 | 19.2 | 0.2 | 0.4 |
| 2766-21 | 17.5 | 5.9 | 20.2 | 38.9 | 17.3 | 0.1 | 0.2 |
| 2766-2 | 18.7 | 5.5 | 15.8 | 40.0 | 20.0 | 0.0 | 0.0 |
| 2766-3 | 16.9 | 7.2 | 26.1 | 36.7 | 13.1 | 0.0 | 0.0 |
| 2766-6 | 16.5 | 7.1 | 27.2 | 36.9 | 12.2 | 0.0 | 0.0 |
| 2766-7 | 15.9 | 7.3 | 29.8 | 34.7 | 12.3 | 0.0 | 0.0 |
| 2766-8 | 17.3 | 5.4 | 19.1 | 39.9 | 18.3 | 0.0 | 0.0 |
| 2766-9 | 16.6 | 8.0 | 28.5 | 34.8 | 12.1 | 0.0 | 0.0 |
| 2766-14 | 16.7 | 7.3 | 26.5 | 36.7 | 12.8 | 0.0 | 0.0 |
| 2766-20 | 17.6 | 5.1 | 16.9 | 41.0 | 19.4 | 0.0 | 0.0 |
| 2766-23 | 17.7 | 5.3 | 18.0 | 40.4 | 18.5 | 0.0 | 0.0 |
| 2766-24 | 17.8 | 6.2 | 22.1 | 35.6 | 18.3 | 0.0 | 0.0 |
| 2766-25 | 17.2 | 5.2 | 17.0 | 44.2 | 16.5 | 0.0 | 0.0 |
| 2766-28 | 17.5 | 5.3 | 18.1 | 41.5 | 17.6 | 0.0 | 0.0 |
| 2766-29 | 18.1 | 5.8 | 20.6 | 37.6 | 17.8 | 0.0 | 0.0 |
| Avg.* | 16.9 | 6.2 | 23.2 | 38.7 | 14.5 | 0.4 | 1.1 |
| Avg.** | 16.4 | 6.4 | 25.4 | 38.0 | 13.1 | 0.8 | 2.1 |

A summary of the average fatty acid profiles for the five events having highest VERN content from each experiment (Avg. **) is shown in TABLE 56. In TABLE 56, the calculated % epoxidation conversion efficiency (% Epox) to VERN is also shown for the average of the five events having highest VERN content from each experiment where the % Epox was calculated by dividing the sum of the average weight percent (wt. %) for VERN by the sum of the average wt. % for 18:2 and VERN and multiplying by 100 to express as a %. Also shown in TABLE 56 is the relative % epoxidation (Rel % Epox) for each experiment where the % Epox for the experiment is divided by the % Epox for that of MSE2763 (EuphEpox).

TABLE 56

Comparing average fatty acid profiles for EuphMBOAT
co-expressed with a *Euphorbia* cytochrome
P450 in Soy Somatic Embryos
Summary for top 5 events (EuphEpox in Soy Somatic Embyros)

| Experiment | 16:0 | 18:0 | 18:1 | 18:2 | 18:3 | VERN | % Epox | Rel % Epox |
|---|---|---|---|---|---|---|---|---|
| MSE2763 (EuphEpox) | 16.9 | 5.2 | 18.6 | 37.6 | 21.4 | 0.4 | 1.0 | 1.00 |
| MSE2764 (EuphEpox, EuphMBOAT) | 16.4 | 6.4 | 25.4 | 38.0 | 13.1 | 0.8 | 2.1 | 2.05 |

Example 23

Creating Transgenic *Arabidopsis* Background Events Expressing LC-PUFA Fatty Acids

*Arabidopsis* background events were generated which expressed various LC-PUFA fatty acid biosynthetic genes. These events were then transformed with various MBOAT genes, and the effect on LC-PUFA fatty acid and oil concentrations was determined.

DGLA/ETA-Expressing Transgenic Event (MaD6des/MaD6Elo)

Construction of plasmid pKR1559, transformation into *Arabidopsis* (col-0) and analysis of T2 seed for fatty acid profiles was described above. Events producing DGLA/ETA and which segregated 3:1 for the transgene were carried on, and T3 seed were harvested. Homozygous T3 seed from these events were found not to germinate on plates, but the fatty acid profile for T3 seed from one representative event having good DGLNETA concentrations and which was homozygous for the transgene (1559-17-11) is shown below. Because homozygous T3 seed did not germinate, heterozygous T3 seed was chosen for use as a DGLA/ETA-expressing background, and the fatty acid profile from seed from this event is also shown below in Table 57.

EDA/ERA-Expressing Transgenic Event (EgD9Elo)

Plasmid pKR926, containing the *Euglena gracilis* delta-9 elongase (EgD9Elo) behind the soy beta-conglycinin promoter in an *Arabidopsis* binary transformation vector was described in BB1613. Plasmid pKR926 was transformed into *Arabidopsis* (col-0) and transgenic plants were selected and grown as described in herein. Events producing EDA/ERA and which segregated 3:1 for the transgene were carried on, and T3 seed were harvested. Homozygous T3 seed or T4 seed from these events could not be recovered, likely due to germination issues with the homozygous seed, but the fatty acid profile for T4 seed from one representative event having good EDA/ERA concentrations and which was heterozygous for the transgene (926-5-4-1) is shown below in Table 58.

TABLE 58

Fatty acid profile of heterozygous T4 seed from event 926-5-4-1 expressing a delta-9 elongase
Heterozygous T4 seed for pKR926 (EgD9Elo) background event

| Event # | 16:0 | 18:0 | 18:1 | 18:2 | GLA | 18:3 | STA | 20:0 | 20:1 | EDA | ERA | LA + ALA | EDA + ERA | % D12Des | % D9Elo |
|---|---|---|---|---|---|---|---|---|---|---|---|---|---|---|---|
| 926-5-4-1 (het) | 8.8 | 2.9 | 12.2 | 27.5 | 0.0 | 12.1 | 0.0 | 1.4 | 13.5 | 15.1 | 6.5 | 39.6 | 21.5 | 83% | 35% |

EDA/ERA-Expressing Transgenic Event (EaD9Elo)

Plasmid pKR1191, containing the *Euglena anabaena* delta-9 elongase (EaD9Elo) behind the soy beta-conglycinin promoter, in an *Arabidopsis* binary transformation vector was described in BB1613. Plasmid pKR1191 was transformed into *Arabidopsis* (col-0), and transgenic plants were selected and grown as described herein. Events producing EDA/ERA and which segregated 3:1 for the transgene were carried on, and T3 seed were harvested. T3 seed from one event having good EDA/ERA concentrations and which was homozygous for the transgene (1191-4-11) was chosen for use as a EDA/ERA-expressing background, and the fatty acid profile from seed from this event is shown below in Table 59.

TABLE 57

Fatty acid profile of homozygous and heterozygous T3 seed from event
1559-17-11 expressing a delta-6 desaturase and delta-6 elongase
Heterozygous and Homoyogous T3 seed for pKR1559 (MaD6Des, MaElo) background event

| Event # | 16:0 | 18:0 | 18:1 | 18:2 | GLA | 18:3 | STA | 20:0 | 20:1 | EDA | DGLA | ERA |
|---|---|---|---|---|---|---|---|---|---|---|---|---|
| 1559-17-11 (het) | 8.2 | 3.2 | 15.4 | 25.7 | 5.5 | 16.7 | 1.4 | 1.5 | 16.9 | 2.3 | 2.0 | 0.9 |
| 1559-17-11 (homo) | 8.3 | 3.2 | 13.8 | 20.2 | 9.5 | 15.2 | 2.7 | 1.7 | 17.4 | 2.5 | 3.5 | 1.3 |

| Event # | ETA | LA + ALA | GLA + STA | DGLA + ETA | % D12Des | % D6Des | % D9Elo |
|---|---|---|---|---|---|---|---|
| 1559-17-11 (het) | 0.4 | 42.4 | 6.9 | 2.4 | 77% | 18% | 26% |
| 1559-17-11 (homo) | 0.8 | 35.3 | 12.2 | 4.4 | 79% | 32% | 27% |

TABLE 59

Fatty acid profile of homozygous T3 seed from event 1191-4-11 expressing a delta-9 elongase
Homozygous T3 seed for pKR1191(EaD9Elo) background event

| Event # | 16:0 | 18:0 | 18:1 | 18:2 | GLA | 18:3 | STA | 20:0 | 20:1 | EDA | ERA | LA + ALA | EDA + ERA | % D12Des | % D9Elo |
|---|---|---|---|---|---|---|---|---|---|---|---|---|---|---|---|
| 1191-4-11 | 7.3 | 3.2 | 12.4 | 24.6 | 0.0 | 11.5 | 0.0 | 1.4 | 14.2 | 16.9 | 8.4 | 36.1 | 25.4 | 83% | 41% |

DGLA/ETA-Expressing Transgenic Event (EgD9Elo/TpomD8Des)

Construction of plasmid pKR1022, transformation into *Arabidopsis* (col-0) and analysis of T2 seed for fatty acid profiles was described herein. Events producing DGLA/ETA and which segregated 3:1 for the transgene were carried on, and T3 seed were harvested. T3 seed from one event having good DGLA/ETA concentrations and which was homozygous for the transgene (1022-4-9) was chosen for use as a DGLA/ETA-expressing background, and the fatty acid profile from seed from this event is shown below in Table 60.

TABLE 60

Fatty acid profile of homozygous T3 seed from event 1022-4-9
expressing a delta-9 elongase and delta-8 desaturase
Homozygous T3 seed for pKR1022 (EgD9Elo/TpomD8Des) background event

| Event # | 16:0 | 18:0 | 18:1 | 18:2 | GLA | 18:3 | STA | 20:0 | 20:1 | EDA | DGLA | ERA |
|---|---|---|---|---|---|---|---|---|---|---|---|---|
| 1022-4-9 | 7.6 | 3.0 | 16.6 | 26.2 | 0.0 | 11.1 | 0.0 | 1.2 | 14.4 | 8.9 | 4.4 | 5.2 |

| Event # | ETA | LA + ALA | EDA + ERA | DGLA + ETA | % D12Des | % D9Elo | % D8Des |
|---|---|---|---|---|---|---|---|
| 1022-4-9 | 1.2 | 37.3 | 14.1 | 5.6 | 77% | 35% | 28% |

DGLA/ETA-Expressing Transgenic Event (EaD9Elo/EaD8Des)

Plasmid pKR1192, containing the *Euglena anabaena* delta-9 elongase (EaD9Elo) behind the soy beta-conglycinin promoter and the *Euglena anabaena* delta-8 desatursre behind the soy glycinin Gy1 promoter, in an *Arabidopsis* binary transformation vector was described in BB1615. Plasmid pKR1192 was transformed into *Arabidopsis* (col-0), and transgenic plants were selected and grown as described herein. Events producing DGLA/ETA and which segregated 3:1 for the transgene were carried on, and T3 seed were harvested. T3 seed from one event having good DGLA/ETA concentrations and which was homozygous for the transgene (1192-1-2) was chosen for use as a DGLA/ETA-expressing background, and the fatty acid profile from seed from this event is shown below in Table 61.

DGLA/ETA-Expressing Transgenic Event (EgD9Elo-EaD8Des Fusion)

The AscI fragment of pKR1200 (Published U.S. Patent Application No. 2008/0254191, incorporated herein by reference), containing the *Euglena gracilis* delta-9 elongase at the N-terminus fused to the *Euglena anabaena* delta-8 desaturase at the C-terminus (EgD9Elo-EaD8Des fusion) behind the soy beta-conglycinin promoter, was cloned into the AscI fragment of pKR92 (Published U.S. Patent Application No 2007/0118929, incorporated herein by reference), an *Arabidopsis* binary transformation vector, to produce pKR1203 (SEQ ID NO:145). Plasmid pKR1203 was transformed into *Arabidopsis* (col-0), and transgenic plants were selected and grown as described herein. Events producing DGLA/ETA and which segregated 3:1 for the transgene were carried on, and T3 seed as well as T4 seed were harvested. T4 seed from one event having good DGLA/ETA concentrations and which was homozygous for the transgene (1203-13-1-5) was chosen for use as a DGLA/ETA-expressing background, and the fatty acid profile from seed from this event is shown below in Table 62.

TABLE 61

Fatty acid profile of homozygous T3 seed from event 1192-1-2
expressing a delta-9 elongase and delta-8 desaturase
Homozygous T3 seed for pKR1192 (EaD9Elo/EaD8Des) background event

| Event # | 16:0 | 18:0 | 18:1 | 18:2 | GLA | 18:3 | STA | 20:0 | 20:1 | EDA | DGLA | ERA |
|---|---|---|---|---|---|---|---|---|---|---|---|---|
| 1192-1-2 | 8.4 | 3.5 | 14.7 | 23.5 | 0.0 | 10.7 | 0.0 | 1.4 | 13.5 | 11.2 | 5.4 | 6.0 |

| Event # | ETA | LA + ALA | EDA + ERA | DGLA + ETA | % D12Des | % D9Elo | % D8Des |
|---|---|---|---|---|---|---|---|
| 1192-1-2 | 1.7 | 34.2 | 17.2 | 7.2 | 80% | 42% | 29% |

TABLE 62

Fatty acid profile of homozygous T4 seed from event 1203-13-1-5 expressing a delta-9 elongase and delta-8 desaturase fusion gene
Homozygous T4 seed for pKR1203 (EgD9Elo-EaD8Des fusion) background event

| Event # | 16:0 | 18:0 | 18:1 | 18:2 | GLA | 18:3 | STA | 20:0 | 20:1 | EDA | DGLA | ERA |
|---|---|---|---|---|---|---|---|---|---|---|---|---|
| 1203-13-1-5 | 10.6 | 3.4 | 18.2 | 25.0 | 0.0 | 7.6 | 0.0 | 1.5 | 12.0 | 10.2 | 5.4 | 4.4 |

| Event # | ETA | LA + ALA | EDA + ERA | DGLA + ETA | % D12Des | % D9Elo | % D8Des |
|---|---|---|---|---|---|---|---|
| 1203-13-1-5 | 1.4 | 32.6 | 14.6 | 6.9 | 75% | 40% | 32% |

ARA/EPA-Expressing Event (EaD9Elo/EaD8Des/EaD5Des)

Plasmid pKR1193, containing the *Euglena anabaena* delta-9 elongase (EaD9Elo) behind the soy beta-conglycinin promoter, the *Euglena anabaena* delta-8 desaturase behind the soy glycinin Gy1 promoter and the *Euglena anabaena* delta-5 desaturase behind soy beta-conglycinin promoter, in an *Arabidopsis* binary transformation vector was described in Published U.S. Patent Application No. 2008/0194685, incorporated herein by reference. Plasmid pKR1193 was transformed into *Arabidopsis* (col-0), and transgenic plants were selected and grown as described herein. Events producing ARA/EPA and which segregated 3:1 for the transgene were carried on, and T3 seed as well as T4 seed were harvested. T4 seed from one event having good ARA/EPA concentrations and which was homozygous for the transgene (1193-5-4-6) was chosen for use as an ARA/EPA-expressing background, and the fatty acid profile from seed from this event is shown below in Table 63.

GmMBOAT2, respectively were cloned into the NotI site of pKR72 (described in BB1538) to produce pKR1645 (SEQ ID NO:147) and pKR1646 (SEQ ID NO:148), respectively which allow for expression of the genes from the soy beta-conglycinin promoter.

The NotI fragments of pLF166 (SEQ ID NO:48) and pHD41 (SEQ ID NO:34), containing CoMBOAT and McMBOAT, respectively were cloned into the NotI site of pKR72 (described in Published U.S. Patent Application No. 2004/0172682, incorporated herein by reference) to produce pKR1649 (SEQ ID NO:149) and pKR1650 (SEQ ID NO:150), respectively which allow for expression of the genes from the soy beta-conglycinin promoter.

The NotI fragment of pHD41 (SEQ ID NO:34), containing McMBOAT, was cloned into the NotI site of pKR193 (described in Published U.S. Patent Application No. 2008/0254191, incorporated herein by reference) to produce pKR1818SEQ ID NO:151).

TABLE 63

Fatty acid profile of homozygous T4 seed from event 1193-5-4-6) expressing a delta-9 elongase, a delta-8 desaturase and a delta-5 desaturase.
Homozygous T4 seed for pKR1193 (EaD9Elo/EaD8Des/EaD5Des) background event

| Event # | 16:0 | 18:0 | 18:1 | 18:2 | GLA | 18:3 | STA | 20:0 | 20:1 | EDA | DGLA | ARA | ERA |
|---|---|---|---|---|---|---|---|---|---|---|---|---|---|
| 1193-5-4-6 | 8.3 | 3.2 | 16.4 | 20.5 | 0.0 | 7.6 | 0.0 | 1.5 | 13.0 | 14.6 | 0.5 | 6.7 | 5.9 |

| Event # | ETA | EPA | LA + ALA | EDA + ERA | DGLA + ETA | ARA + EPA | % D12Des | % D9Elo | % D8Des | % D5Des |
|---|---|---|---|---|---|---|---|---|---|---|
| 1193-5-4-6 | 0.0 | 1.9 | 28.1 | 20.4 | 0.5 | 8.6 | 78% | 51% | 31% | 95% |

Example 24

Cloning Soy, *Momordica charantia, Calendula officianalis* and *Euphorbia laqascae* MBOAT Homologs into *Arabidopsis* Binary Vectors and Expression in Various LC-PUFA Producing Backgrounds Cloning Soy, *Momordica charantia, Calendula officianalis* and *Euphorbia* lagascae MBOAT Homologs into *Arabidopsis* Binary Vectors

*Arabidopsis* binary expression plasmid pHD1, described in Published U.S. Patent Application No. 2005/0132441, incorporated herein by reference, contains a unique AscI site for cloning gene expression cassettes and has the acetolactate synthase gene for selecting transgenic plants on sulfonylurea herbicides. An earlier clone of pHD1 was completely resequenced and the sequence is set forth in SEQ ID NO:146.

The NotI fragments of pLF164 (SEQ ID NO:128) and pLF165 (SEQ ID NO:130), containing GmMBOAT1 and The BsiWI fragment of pKR1818 (SEQ ID NO:151), containing the McMBOAT, was cloned into the BsiWI site of pKR277 (described in Published U.S. Patent Application No. 2008/0118623, incorporated herein by reference) to produce pKR1826 (SEQ ID NO:152).

The NotI fragment of pKR1823 (SEQ ID NO:140), containing EuphMBOAT, was cloned into the NotI site of pKR1826 (SEQ ID NO:152) to produce pKR1844 (SEQ ID NO:153).

The AscI fragments of pKR1645 (SEQ ID NO:147), comprising GmMBOAT1, pKR1646SEQ ID NO:148), comprising GmMBOAT2, pKR1649 (SEQ ID NO:149), comprising CoMBOAT, pKR1650 (SEQ ID NO:150), comprising McMBOAT and pKR1844 (SEQ ID NO:153), comprising EuphMBOAT, respectively were all cloned into the AscI site of pHD1 (described in CL2432) to produce pKR1671 (SEQ ID NO:154), pKR1672 (SEQ ID NO:155), pKR1673 (SEQ ID NO:156), pKR1674 (SEQ ID NO:157) and pKR1845 (SEQ ID NO:158), respectively.

Expressing Soy, *Momordica charantia, Calendula officianalis* and *Euphorbia lagascae* MBOAT Homologs in Various Unusual Fatty Acid-Expressing Backgrounds T3 or T4 seed from each *Arabidopsis* background described in Example 23 above was planted in flats, and plants were grown and transformed with either pHD1 (vector control), pKR1671 (GmMBOAT1), pKR1672 (GmMBOAT2), pKR1673 (CoMBOAT), pKR1674 (McMBOAT) or pKR1845 (EuphMBOAT) as described in for *Arabidopsis* transformation herein. Transgenic seed were selected by plating onto MS plates as described but substituting Kanamycin with Glean (sulfonylurea herbicide) at a concentration of 200 ppb. T1 plants were grown, and T2 seed were harvested and analyzed for fatty acid profile and oil content as described herein for each event. Results are presented below in Tables 64, 65, 66, 67, 68, 69 and 70 for analysis of T2 seed from a number of events for each LC-PUFA-containing background transformed. For DGLA/ETA-expressing event 1022-4-9, T3 seed was also obtained, and oil and fatty acid analysis was completed on three separate homozygous T3 seed batches and results in Table 71.

In the Tables, % delta-12 desaturation (% D12Des) was calculated by dividing the sum of the average weight percent (wt. %) for 18:2, 18:3, GLA, STA, DGLA, ETA, ARA and EPA by the sum of the average wt. % for 18:1, 18:2, 18:3, GLA, STA, DGLA, ETA, ARA and EPA and multiplying by 100 to express as a %.

For *Arabidopsis* backgrounds expressing a delta-6 desaturase pathway, the calculated % delta-6 desaturase conversion efficiency (% D6Des) was calculated by dividing the sum of the average weight percent (wt. %) for GLA, STA, DGLA, ETA, ARA and EPA by the sum of the average wt. % for 18:2, 18:3, GLA, STA, DGLA, ETA, ARA and EPA and multiplying by 100 to express as a %. Similarly, the calculated % delta-6 elongase conversion efficiency (% D6Elo) was calculated by dividing the sum of the average weight percent (wt. %) for DGLA, ETA, ARA and EPA by the sum of the average wt. % for GLA, STA, DGLA, ETA, ARA and EPA and multiplying by 100 to express as a %.

For *Arabidopsis* backgrounds expressing a delta-9 elongase pathway, the calculated % $C_{16}$ to $C_{20}$ elongation conversion efficiency (% D9Elo) was calculated by dividing the sum of the average weight percent (wt. %) for EDA, ERA, DGLA, ETA, ARA and EPA by the sum of the average wt. % for 18:2, 18:3, EDA, ERA, DGLA, ETA, ARA and EPA and multiplying by 100 to express as a %. Similarly, the calculated % delta-8 desaturase conversion efficiency (% D8Des) was calculated by dividing the sum of the average weight percent (wt. %) for DGLA, ETA, ARA and EPA by the sum of the average wt. % for EDA, ERA, DGLA, ETA, ARA and EPA and multiplying by 100 to express as a %.

The calculated % delta-5 desaturase conversion efficiency (% D5Des) was calculated by dividing the sum of the average weight percent (wt. %) for ARA and EPA by the sum of the average wt. % for DGLA, ETA, ARA and EPA and multiplying by 100 to express as a %.

If a certain fatty acid is not present in the pathway, it was not included in the calculations.

TABLE 64

Fatty acid profile of T2 seed from events expressing MBOATs in DGLA/ETA-expressing transgenic event 1559-17-11 (MaD6des/MaD6Elo)
T2 seed for pKR1559 (MaD6Des, MaElo) background event transformed with various MBOATs

| Event # | MBOAT | Bkgrnd | % Oil | 16:0 | 18:0 | 18:1 | 18:2 | GLA | 18:3 | STA | 20:0 | 20:1 | EDA | DGLA | ERA | ETA |
|---|---|---|---|---|---|---|---|---|---|---|---|---|---|---|---|---|
| 1559-17-11 (het) | | 1559-17-11 (het) | | 8.2 | 3.2 | 15.4 | 25.7 | 5.5 | 16.7 | 1.4 | 1.5 | 16.9 | 2.3 | 2.0 | 0.9 | 0.4 |
| 1559-17-11 (homo) | | 1559-17-11 (homo) | | 8.3 | 3.2 | 13.8 | 20.2 | 9.5 | 15.2 | 2.7 | 1.7 | 17.4 | 2.5 | 3.5 | 1.3 | 0.8 |
| HD1-6 | Vect Cont | 1559-17-11 | | 7.6 | 2.6 | 14.5 | 19.2 | 5.4 | 20.8 | 2.7 | 1.5 | 16.9 | 2.7 | 3.3 | 1.8 | 1.1 |
| HD1-15 | Vect Cont | 1559-17-11 | | 6.8 | 2.7 | 15.5 | 20.0 | 4.9 | 20.3 | 2.1 | 1.6 | 18.8 | 2.7 | 2.4 | 1.6 | 0.7 |
| HD1-13 | Vect Cont | 1559-17-11 | | 6.6 | 2.8 | 17.9 | 21.8 | 3.5 | 19.3 | 1.3 | 1.8 | 19.0 | 2.4 | 2.0 | 1.2 | 0.5 |
| HD1-12 | Vect Cont | 1559-17-11 | | 7.1 | 2.8 | 15.6 | 23.3 | 4.2 | 19.3 | 1.4 | 1.7 | 18.6 | 2.6 | 1.9 | 1.2 | 0.5 |
| HD1-1 | Vect Cont | 1559-17-11 | | 7.7 | 3.3 | 15.8 | 25.9 | 4.8 | 16.7 | 1.2 | 1.6 | 17.6 | 2.3 | 1.8 | 0.9 | 0.4 |
| HD1-8 | Vect Cont | 1559-17-11 | | 8.0 | 3.3 | 15.8 | 26.2 | 4.7 | 16.7 | 1.2 | 1.7 | 17.2 | 2.3 | 1.8 | 0.9 | 0.4 |
| HD1-4 | Vect Cont | 1559-17-11 | | 8.3 | 3.0 | 17.1 | 26.8 | 4.7 | 16.7 | 1.1 | 1.5 | 16.0 | 2.1 | 1.8 | 0.7 | 0.3 |
| HD1-5 | Vect Cont | 1559-17-11 | | 8.2 | 3.1 | 16.6 | 27.7 | 4.5 | 16.6 | 1.1 | 1.4 | 16.1 | 2.1 | 1.7 | 0.7 | 0.3 |
| HD1-16 | Vect Cont | 1559-17-11 | | 7.7 | 3.3 | 16.5 | 25.7 | 4.3 | 15.5 | 1.0 | 1.9 | 19.0 | 2.3 | 1.6 | 0.8 | 0.3 |
| HD1-7 | Vect Cont | 1559-17-11 | | 8.0 | 3.2 | 16.6 | 27.0 | 4.2 | 16.5 | 1.0 | 1.6 | 17.2 | 2.2 | 1.6 | 0.7 | 0.3 |
| HD1-3 | Vect Cont | 1559-17-11 | | 7.9 | 3.2 | 15.9 | 26.4 | 4.2 | 17.1 | 1.0 | 1.7 | 17.7 | 2.3 | 1.5 | 0.8 | 0.3 |
| HD1-2 | Vect Cont | 1559-17-11 | | 8.5 | 3.1 | 17.1 | 27.7 | 4.3 | 16.5 | 1.0 | 1.5 | 15.8 | 2.0 | 1.5 | 0.7 | 0.3 |
| HD1-9 | Vect Cont | 1559-17-11 | | 8.0 | 3.3 | 16.2 | 27.0 | 3.9 | 16.7 | 0.9 | 1.7 | 17.6 | 2.2 | 1.4 | 0.7 | 0.3 |
| HD1-17 | Vect Cont | 1559-17-11 | | 7.6 | 3.5 | 16.3 | 26.0 | 3.8 | 16.0 | 0.9 | 2.0 | 19.1 | 2.4 | 1.4 | 0.8 | 0.3 |
| HD1-14 | Vect Cont | 1559-17-11 | | 7.6 | 3.5 | 16.3 | 26.0 | 3.9 | 15.7 | 0.9 | 2.0 | 19.2 | 2.3 | 1.4 | 0.8 | 0.3 |
| HD1-10 | Vect Cont | 1559-17-11 | | 8.1 | 3.3 | 16.2 | 27.2 | 3.8 | 16.4 | 0.9 | 1.8 | 17.7 | 2.2 | 1.4 | 0.8 | 0.3 |
| HD1-18 | Vect Cont | 1559-17-11 | | 8.1 | 3.4 | 16.6 | 26.6 | 3.8 | 16.0 | 0.9 | 1.9 | 18.3 | 2.2 | 1.3 | 0.7 | 0.3 |
| HD1-11 | Vect Cont | 1559-17-11 | | 7.8 | 3.4 | 16.8 | 27.2 | 3.6 | 15.8 | 0.8 | 1.9 | 18.3 | 2.2 | 1.3 | 0.7 | 0.3 |
| Top5 Avg. | | | | 7.2 | 2.8 | 15.9 | 22.0 | 4.5 | 19.3 | 1.7 | 1.6 | 18.2 | 2.5 | 2.3 | 1.3 | 0.6 |
| 1671-8 | GmMBOAT1 | 1559-17-11 | | 7.7 | 2.7 | 12.8 | 28.4 | 1.9 | 21.5 | 0.6 | 1.7 | 9.7 | 3.5 | 5.8 | 2.4 | 1.4 |
| 1671-10 | GmMBOAT1 | 1559-17-11 | | 7.8 | 2.6 | 13.1 | 29.0 | 1.9 | 21.4 | 0.6 | 1.6 | 9.6 | 3.3 | 5.8 | 2.2 | 1.3 |
| 1671-5 | GmMBOAT1 | 1559-17-11 | | 7.0 | 2.5 | 15.3 | 26.7 | 1.7 | 21.9 | 0.6 | 1.6 | 10.7 | 3.1 | 5.2 | 2.2 | 1.4 |
| 1671-12 | GmMBOAT1 | 1559-17-11 | | 6.7 | 2.7 | 15.0 | 29.2 | 1.7 | 18.8 | 0.5 | 1.7 | 11.5 | 3.8 | 5.4 | 2.1 | 1.0 |
| 1671-3 | GmMBOAT1 | 1559-17-11 | | 6.8 | 2.7 | 16.4 | 33.5 | 0.9 | 14.0 | 0.1 | 1.8 | 11.7 | 4.6 | 5.1 | 1.7 | 0.6 |
| 1671-2 | GmMBOAT1 | 1559-17-11 | | 7.6 | 2.6 | 11.9 | 29.4 | 2.4 | 22.8 | 0.7 | 1.7 | 9.6 | 3.4 | 4.5 | 2.3 | 1.1 |
| 1671-6 | GmMBOAT1 | 1559-17-11 | | 7.7 | 2.8 | 13.1 | 30.9 | 2.3 | 17.4 | 0.5 | 1.8 | 10.7 | 4.7 | 4.8 | 2.5 | 0.8 |
| 1671-14 | GmMBOAT1 | 1559-17-11 | | 7.6 | 2.7 | 13.4 | 31.7 | 2.0 | 19.9 | 0.5 | 1.6 | 11.3 | 3.1 | 3.8 | 1.6 | 0.8 |
| 1671-1 | GmMBOAT1 | 1559-17-11 | | 7.3 | 3.3 | 16.1 | 25.2 | 5.3 | 15.3 | 1.3 | 1.7 | 18.1 | 2.5 | 2.4 | 1.0 | 0.5 |
| 1671-16 | GmMBOAT1 | 1559-17-11 | | 8.0 | 3.3 | 15.7 | 25.6 | 5.4 | 16.3 | 1.3 | 1.7 | 17.1 | 2.3 | 2.0 | 0.9 | 0.4 |
| 1671-13 | GmMBOAT1 | 1559-17-11 | | 7.5 | 3.1 | 17.2 | 27.0 | 4.4 | 15.5 | 1.0 | 1.6 | 17.6 | 2.2 | 1.8 | 0.7 | 0.3 |
| 1671-18 | GmMBOAT1 | 1559-17-11 | | 8.1 | 3.1 | 15.9 | 26.4 | 4.8 | 16.6 | 1.2 | 1.6 | 17.1 | 2.2 | 1.8 | 0.8 | 0.4 |
| 1671-17 | GmMBOAT1 | 1559-17-11 | | 7.3 | 3.5 | 16.2 | 25.7 | 4.2 | 15.6 | 1.0 | 1.9 | 19.0 | 2.4 | 1.8 | 0.9 | 0.4 |
| 1671-9 | GmMBOAT1 | 1559-17-11 | | 7.6 | 3.3 | 15.9 | 25.9 | 4.6 | 16.1 | 1.1 | 1.8 | 18.3 | 2.4 | 1.7 | 0.9 | 0.4 |

TABLE 64-continued

Fatty acid profile of T2 seed from events expressing MBOATs in DGLA/ETA-expressing transgenic event 1559-17-11 (MaD6des/MaD6Elo)
T2 seed for pKR1559 (MaD6Des, MaElo) background event transformed with various MBOATs

| | | | | | | | | | | | | | | |
|---|---|---|---|---|---|---|---|---|---|---|---|---|---|---|
| 1671-7 | GmMBOAT1 | 1559-17-11 | | 7.3 | 3.5 | 16.5 | 25.8 | 4.5 | 15.2 | 1.0 | 1.9 | 18.9 | 2.4 | 1.7 | 0.9 | 0.3 |
| 1671-4 | GmMBOAT1 | 1559-17-11 | | 7.7 | 3.4 | 16.8 | 26.6 | 4.0 | 15.5 | 0.9 | 1.9 | 18.0 | 2.4 | 1.6 | 0.8 | 0.3 |
| 1671-15 | GmMBOAT1 | 1559-17-11 | | 7.7 | 3.3 | 16.2 | 26.6 | 4.2 | 16.1 | 1.0 | 1.8 | 18.1 | 2.3 | 1.5 | 0.8 | 0.3 |
| 1671-11 | GmMBOAT1 | 1559-17-11 | | 7.6 | 3.4 | 16.2 | 26.3 | 3.7 | 16.3 | 0.9 | 1.9 | 18.6 | 2.3 | 1.5 | 0.8 | 0.3 |
| Top5 Avg. | | | | 7.2 | 2.6 | 14.5 | 29.4 | 1.6 | 19.5 | 0.5 | 1.7 | 10.6 | 3.7 | 5.5 | 2.1 | 1.1 |
| 1672-14 | GmMBOAT2 | 1559-17-11 | | 8.2 | 2.4 | 12.7 | 25.8 | 2.0 | 23.3 | 0.8 | 1.3 | 8.7 | 2.6 | 7.7 | 2.1 | 2.5 |
| 1672-9 | GmMBOAT2 | 1559-17-11 | | 6.7 | 2.6 | 13.7 | 27.0 | 1.9 | 18.1 | 0.5 | 1.7 | 11.3 | 4.2 | 8.1 | 2.6 | 1.7 |
| 1672-8 | GmMBOAT2 | 1559-17-11 | | 6.9 | 2.5 | 11.7 | 24.4 | 2.9 | 22.1 | 1.0 | 1.7 | 11.7 | 3.3 | 7.3 | 2.5 | 2.1 |
| 1672-16 | GmMBOAT2 | 1559-17-11 | | 7.8 | 2.8 | 14.2 | 25.6 | 2.3 | 20.3 | 0.8 | 1.7 | 10.8 | 2.8 | 7.0 | 2.0 | 2.0 |
| 1672-1 | GmMBOAT2 | 1559-17-11 | | 7.6 | 2.7 | 18.2 | 25.4 | 2.0 | 19.5 | 0.6 | 1.7 | 11.1 | 2.5 | 5.6 | 1.6 | 1.5 |
| 1672-18 | GmMBOAT2 | 1559-17-11 | | 6.9 | 2.8 | 13.8 | 25.8 | 2.6 | 19.5 | 0.7 | 1.9 | 13.4 | 3.5 | 5.8 | 2.1 | 1.2 |
| 1672-12 | GmMBOAT2 | 1559-17-11 | | 7.1 | 2.7 | 13.1 | 27.7 | 1.6 | 20.9 | 0.5 | 1.8 | 12.8 | 3.1 | 5.5 | 1.9 | 1.4 |
| 1672-2 | GmMBOAT2 | 1559-17-11 | | 7.1 | 2.7 | 12.9 | 25.6 | 2.8 | 21.2 | 0.9 | 1.8 | 13.8 | 3.0 | 5.0 | 1.9 | 1.3 |
| 1672-11 | GmMBOAT2 | 1559-17-11 | | 6.5 | 2.7 | 14.0 | 26.1 | 2.6 | 20.5 | 0.8 | 1.7 | 14.0 | 3.2 | 4.8 | 1.9 | 1.2 |
| 1672-13 | GmMBOAT2 | 1559-17-11 | | 6.9 | 2.8 | 14.1 | 29.0 | 2.1 | 19.0 | 0.5 | 1.9 | 13.4 | 3.2 | 4.6 | 1.7 | 0.9 |
| 1672-15 | GmMBOAT2 | 1559-17-11 | | 6.6 | 2.8 | 14.8 | 26.9 | 2.4 | 19.3 | 0.7 | 1.8 | 15.0 | 3.1 | 4.1 | 1.6 | 0.9 |
| 1672-5 | GmMBOAT2 | 1559-17-11 | | 7.5 | 3.0 | 14.5 | 31.3 | 2.5 | 17.4 | 0.6 | 1.7 | 12.2 | 3.1 | 4.2 | 1.4 | 0.7 |
| 1672-7 | GmMBOAT2 | 1559-17-11 | | 7.6 | 3.2 | 15.2 | 29.0 | 2.5 | 17.3 | 0.6 | 1.9 | 15.5 | 2.7 | 3.0 | 1.0 | 0.5 |
| 1672-10 | GmMBOAT2 | 1559-17-11 | | 7.9 | 3.4 | 14.7 | 25.3 | 5.1 | 16.5 | 1.3 | 1.8 | 18.3 | 2.4 | 2.0 | 1.0 | 0.4 |
| 1672-3 | GmMBOAT2 | 1559-17-11 | | 7.7 | 3.1 | 15.7 | 26.2 | 4.9 | 16.9 | 1.2 | 1.5 | 17.4 | 2.3 | 1.9 | 0.9 | 0.4 |
| 1672-17 | GmMBOAT2 | 1559-17-11 | | 7.6 | 3.3 | 16.4 | 26.1 | 4.4 | 15.0 | 1.1 | 1.9 | 19.0 | 2.4 | 1.8 | 0.8 | 0.4 |
| 1672-6 | GmMBOAT2 | 1559-17-11 | | 8.1 | 3.1 | 16.0 | 26.9 | 4.4 | 16.8 | 1.1 | 1.6 | 17.2 | 2.2 | 1.5 | 0.8 | 0.3 |
| 1672-4 | GmMBOAT2 | 1559-17-11 | | 8.0 | 3.2 | 16.4 | 26.8 | 4.1 | 16.6 | 1.0 | 1.7 | 17.6 | 2.2 | 1.4 | 0.8 | 0.3 |
| Top5 Avg. | | | | 7.5 | 2.6 | 14.1 | 25.6 | 2.2 | 20.6 | 0.7 | 1.6 | 10.7 | 3.1 | 7.1 | 2.2 | 2.0 |
| 1673-16 | CoMBOAT | 1559-17-11 | | 7.5 | 2.9 | 13.3 | 23.8 | 4.7 | 16.9 | 1.3 | 1.8 | 16.5 | 3.0 | 5.4 | 1.6 | 1.2 |
| 1673-11 | CoMBOAT | 1559-17-11 | | 7.2 | 2.6 | 17.6 | 22.8 | 2.9 | 19.5 | 1.1 | 1.5 | 14.1 | 2.8 | 4.8 | 1.7 | 1.4 |
| 1673-10 | CoMBOAT | 1559-17-11 | | 7.4 | 3.4 | 16.5 | 25.7 | 0.2 | 11.6 | 0.0 | 1.6 | 15.9 | 8.9 | 3.7 | 4.4 | 0.8 |
| 1673-3 | CoMBOAT | 1559-17-11 | | 7.2 | 3.4 | 16.4 | 25.2 | 0.2 | 11.2 | 0.0 | 1.7 | 16.0 | 9.6 | 3.7 | 4.7 | 0.8 |
| 1673-2 | CoMBOAT | 1559-17-11 | | 7.2 | 3.4 | 16.8 | 25.5 | 0.1 | 11.4 | 0.0 | 1.7 | 16.0 | 9.1 | 3.5 | 4.5 | 0.7 |
| 1673-12 | CoMBOAT | 1559-17-11 | | 7.1 | 2.6 | 15.0 | 23.3 | 3.8 | 20.6 | 1.3 | 1.6 | 16.8 | 2.6 | 3.0 | 1.4 | 0.8 |
| 1673-15 | CoMBOAT | 1559-17-11 | | 6.3 | 2.5 | 14.8 | 19.5 | 5.3 | 20.4 | 2.3 | 1.6 | 19.3 | 2.7 | 2.8 | 1.6 | 0.9 |
| 1673-17 | CoMBOAT | 1559-17-11 | | 7.0 | 3.4 | 15.5 | 23.6 | 6.0 | 15.1 | 1.5 | 1.9 | 19.3 | 2.7 | 2.5 | 1.1 | 0.5 |
| 1673-8 | CoMBOAT | 1559-17-11 | | 7.6 | 3.2 | 15.6 | 24.9 | 6.0 | 15.1 | 1.4 | 1.7 | 17.8 | 2.5 | 2.5 | 1.0 | 0.5 |
| 1673-6 | CoMBOAT | 1559-17-11 | | 8.2 | 3.2 | 14.9 | 25.1 | 6.0 | 16.8 | 1.6 | 1.5 | 16.5 | 2.4 | 2.3 | 1.0 | 0.5 |
| 1673-5 | CoMBOAT | 1559-17-11 | | 7.7 | 3.2 | 15.5 | 25.2 | 5.5 | 16.3 | 1.4 | 1.6 | 17.6 | 2.5 | 2.2 | 1.0 | 0.5 |
| 1673-4 | CoMBOAT | 1559-17-11 | | 7.4 | 3.4 | 16.9 | 25.7 | 4.9 | 14.7 | 1.1 | 1.9 | 18.5 | 2.4 | 1.9 | 0.9 | 0.4 |
| 1673-1 | CoMBOAT | 1559-17-11 | | 7.4 | 3.4 | 16.0 | 25.3 | 4.7 | 15.6 | 1.1 | 1.9 | 19.0 | 2.5 | 1.8 | 0.9 | 0.4 |
| 1673-7 | CoMBOAT | 1559-17-11 | | 7.4 | 3.3 | 16.5 | 25.2 | 4.8 | 15.5 | 1.2 | 1.9 | 18.9 | 2.4 | 1.8 | 0.9 | 0.4 |
| 1673-13 | CoMBOAT | 1559-17-11 | | 7.2 | 3.4 | 16.5 | 26.3 | 4.3 | 15.3 | 1.0 | 1.9 | 18.9 | 2.4 | 1.7 | 0.8 | 0.3 |
| 1673-9 | CoMBOAT | 1559-17-11 | | 7.9 | 3.2 | 15.6 | 25.6 | 4.8 | 16.9 | 1.2 | 1.7 | 17.9 | 2.3 | 1.7 | 0.9 | 0.4 |
| 1673-18 | CoMBOAT | 1559-17-11 | | 7.9 | 3.3 | 16.3 | 26.2 | 4.3 | 15.6 | 1.1 | 1.9 | 18.3 | 2.3 | 1.6 | 0.8 | 0.4 |
| 1673-14 | CoMBOAT | 1559-17-11 | | 7.9 | 3.4 | 16.7 | 26.8 | 3.8 | 15.9 | 0.9 | 1.9 | 18.1 | 2.2 | 1.3 | 0.7 | 0.3 |
| Top5 Avg. | | | | 7.3 | 3.1 | 16.1 | 24.6 | 1.6 | 14.1 | 0.5 | 1.7 | 15.7 | 6.7 | 4.2 | 3.4 | 1.0 |
| 1674-15 | McMBOAT | 1559-17-11 | | 6.8 | 2.6 | 13.5 | 19.9 | 8.0 | 15.9 | 2.6 | 1.6 | 16.5 | 3.1 | 6.2 | 1.8 | 1.5 |
| 1674-11 | McMBOAT | 1559-17-11 | | 6.9 | 2.5 | 14.1 | 27.5 | 2.4 | 20.3 | 0.6 | 1.5 | 11.5 | 3.2 | 6.1 | 2.0 | 1.3 |
| 1674-6 | McMBOAT | 1559-17-11 | | 7.9 | 2.7 | 14.2 | 25.2 | 2.7 | 20.8 | 0.9 | 1.7 | 12.4 | 2.5 | 5.7 | 1.7 | 1.6 |
| 1674-8 | McMBOAT | 1559-17-11 | | 7.1 | 2.6 | 12.9 | 24.5 | 2.8 | 22.5 | 1.0 | 1.8 | 13.3 | 2.8 | 5.2 | 1.9 | 1.5 |
| 1674-1 | McMBOAT | 1559-17-11 | | 6.6 | 2.7 | 13.9 | 24.6 | 3.4 | 20.1 | 1.0 | 1.8 | 14.6 | 3.1 | 5.0 | 1.9 | 1.3 |
| 1674-9 | McMBOAT | 1559-17-11 | | 7.0 | 2.4 | 14.7 | 27.4 | 1.8 | 22.5 | 0.5 | 1.6 | 11.2 | 2.9 | 4.8 | 1.9 | 1.2 |
| 1674-2 | McMBOAT | 1559-17-11 | | 6.8 | 2.8 | 13.9 | 25.4 | 3.4 | 19.6 | 0.9 | 1.8 | 14.7 | 3.1 | 4.8 | 1.8 | 1.1 |
| 1674-3 | McMBOAT | 1559-17-11 | | 6.7 | 2.8 | 14.9 | 26.2 | 2.8 | 20.0 | 0.8 | 1.8 | 15.4 | 2.9 | 3.4 | 1.5 | 0.8 |
| 1674-13 | McMBOAT | 1559-17-11 | | 7.3 | 2.8 | 16.0 | 27.2 | 3.7 | 17.3 | 0.9 | 1.5 | 16.6 | 2.5 | 2.5 | 1.0 | 0.5 |
| 1674-14 | McMBOAT | 1559-17-11 | | 8.2 | 3.1 | 14.4 | 25.8 | 5.5 | 17.1 | 1.4 | 1.5 | 17.0 | 2.3 | 2.2 | 0.9 | 0.5 |
| 1674-17 | McMBOAT | 1559-17-11 | | 7.8 | 3.3 | 15.4 | 24.6 | 5.8 | 16.3 | 1.5 | 1.7 | 17.7 | 2.4 | 2.2 | 1.0 | 0.5 |
| 1674-18 | McMBOAT | 1559-17-11 | | 8.3 | 3.3 | 15.5 | 25.2 | 5.6 | 16.6 | 1.5 | 1.6 | 16.7 | 2.3 | 2.0 | 1.0 | 0.4 |
| 1674-4 | McMBOAT | 1559-17-11 | | 7.5 | 3.4 | 15.7 | 25.3 | 4.5 | 16.1 | 1.1 | 1.9 | 18.9 | 2.5 | 1.8 | 1.0 | 0.4 |
| 1674-16 | McMBOAT | 1559-17-11 | | 8.3 | 3.2 | 16.4 | 26.3 | 5.0 | 16.5 | 1.2 | 1.6 | 16.3 | 2.1 | 1.8 | 0.8 | 0.4 |
| 1674-10 | McMBOAT | 1559-17-11 | | 8.6 | 3.1 | 14.9 | 26.9 | 4.8 | 17.4 | 1.2 | 1.5 | 16.4 | 2.2 | 1.7 | 0.8 | 0.4 |
| 1674-12 | McMBOAT | 1559-17-11 | | 8.3 | 3.2 | 15.1 | 26.9 | 4.5 | 17.1 | 1.2 | 1.7 | 17.1 | 2.2 | 1.7 | 0.8 | 0.3 |
| 1674-5 | McMBOAT | 1559-17-11 | | 7.6 | 3.2 | 16.4 | 26.5 | 4.3 | 15.9 | 1.0 | 1.7 | 18.2 | 2.3 | 1.7 | 0.8 | 0.3 |
| 1674-7 | McMBOAT | 1559-17-11 | | 7.5 | 3.4 | 17.0 | 26.6 | 3.9 | 15.4 | 0.9 | 1.9 | 18.7 | 2.2 | 1.4 | 0.7 | 0.3 |
| Top5 Avg. | | | | 7.1 | 2.6 | 13.7 | 24.3 | 3.9 | 19.9 | 1.2 | 1.7 | 13.7 | 3.0 | 5.6 | 1.8 | 1.4 |
| 1845-2 | EuphMBOAT | 1559-17-11-8 | 23.2 | 7.5 | 3.4 | 12.1 | 18.6 | 8.6 | 13.7 | 2.1 | 2.0 | 15.4 | 3.5 | 8.6 | 2.4 | 0.0 |
| 1845-1 | EuphMBOAT | 1559-17-11-8 | 29.4 | 7.2 | 3.0 | 14.9 | 24.6 | 4.5 | 14.4 | 0.9 | 2.3 | 17.1 | 3.3 | 5.6 | 1.3 | 0.9 |
| 1845-13 | EuphMBOAT | 1559-17-11-8 | 31.0 | 7.5 | 2.9 | 14.1 | 22.8 | 6.4 | 14.5 | 1.5 | 2.1 | 17.6 | 3.1 | 4.9 | 1.5 | 1.0 |
| 1845-9 | EuphMBOAT | 1559-17-11-8 | 28.9 | 6.7 | 3.0 | 16.0 | 24.1 | 4.0 | 15.2 | 1.0 | 2.3 | 17.0 | 2.9 | 5.0 | 1.3 | 0.9 |
| 1845-10 | EuphMBOAT | 1559-17-11-8 | 26.5 | 6.7 | 3.0 | 14.5 | 22.5 | 4.4 | 17.3 | 1.3 | 2.0 | 16.9 | 3.2 | 5.4 | 1.6 | 0.0 |
| 1845-7 | EuphMBOAT | 1559-17-11-8 | 31.7 | 7.0 | 3.1 | 15.3 | 21.2 | 5.3 | 16.5 | 1.5 | 2.2 | 18.1 | 2.8 | 4.3 | 1.3 | 0.9 |
| 1845-6 | EuphMBOAT | 1559-17-11-8 | 29.7 | 6.3 | 2.8 | 14.3 | 19.4 | 6.2 | 17.9 | 2.0 | 1.8 | 18.9 | 2.9 | 4.5 | 1.7 | 0.0 |
| 1845-8 | EuphMBOAT | 1559-17-11-8 | 30.9 | 6.8 | 3.1 | 15.5 | 22.6 | 4.9 | 16.6 | 1.3 | 2.0 | 18.4 | 2.8 | 3.7 | 1.6 | 0.0 |
| 1845-14 | EuphMBOAT | 1559-17-11-8 | 30.2 | 6.7 | 2.8 | 14.4 | 23.0 | 4.6 | 17.9 | 1.4 | 1.8 | 18.4 | 2.9 | 3.6 | 1.5 | 0.0 |
| 1845-4 | EuphMBOAT | 1559-17-11-8 | 30.7 | 6.5 | 2.8 | 15.8 | 22.7 | 4.4 | 17.2 | 1.2 | 1.9 | 19.2 | 2.7 | 3.4 | 1.2 | 0.0 |
| 1845-12 | EuphMBOAT | 1559-17-11-8 | 36.1 | 6.9 | 3.0 | 16.5 | 23.7 | 5.4 | 15.2 | 1.3 | 1.8 | 19.7 | 2.5 | 2.5 | 0.9 | 0.0 |
| Top5 Avg. | | | 27.8 | 7.1 | 3.1 | 14.3 | 22.5 | 5.6 | 15.0 | 1.4 | 2.2 | 16.8 | 3.2 | 5.9 | 1.6 | 0.6 |

TABLE 64-continued

Fatty acid profile of T2 seed from events expressing MBOATs in DGLA/ETA-expressing transgenic event 1559-17-11 (MaD6des/MaD6Elo)
T2 seed for pKR1559 (MaD6Des, MaElo) background event transformed with various MBOATs

| Event # | MBOAT | Bkgrnd | LA + ALA | GLA + STA | DGLA + ETA | % D12Des | % D6Des | % D6Elo |
|---|---|---|---|---|---|---|---|---|
| 1559-17-11 (het) | | 1559-17-11 (het) | 42.4 | 6.9 | 2.4 | 77% | 18% | 26% |
| 1559-17-11 (homo) | | 1559-17-11 (homo) | 35.3 | 12.2 | 4.4 | 79% | 32% | 27% |
| HD1-6 | Vect Cont | 1559-17-11 | 40.0 | 8.1 | 4.4 | 78% | 24% | 35% |
| HD1-15 | Vect Cont | 1559-17-11 | 40.3 | 6.9 | 3.1 | 76% | 20% | 31% |
| HD1-13 | Vect Cont | 1559-17-11 | 41.2 | 4.8 | 2.5 | 73% | 15% | 34% |
| HD1-12 | Vect Cont | 1559-17-11 | 42.5 | 5.6 | 2.3 | 76% | 16% | 29% |
| HD1-1 | Vect Cont | 1559-17-11 | 42.6 | 6.0 | 2.2 | 76% | 16% | 27% |
| HD1-8 | Vect Cont | 1559-17-11 | 42.9 | 5.9 | 2.2 | 76% | 16% | 27% |
| HD1-4 | Vect Cont | 1559-17-11 | 43.5 | 5.8 | 2.1 | 75% | 15% | 27% |
| HD1-5 | Vect Cont | 1559-17-11 | 44.3 | 5.6 | 2.0 | 76% | 15% | 26% |
| HD1-16 | Vect Cont | 1559-17-11 | 41.2 | 5.3 | 1.9 | 75% | 15% | 27% |
| HD1-7 | Vect Cont | 1559-17-11 | 43.6 | 5.2 | 1.9 | 75% | 14% | 27% |
| HD1-3 | Vect Cont | 1559-17-11 | 43.4 | 5.2 | 1.8 | 76% | 14% | 26% |
| HD1-2 | Vect Cont | 1559-17-11 | 44.3 | 5.3 | 1.7 | 75% | 14% | 25% |
| HD1-9 | Vect Cont | 1559-17-11 | 43.6 | 4.9 | 1.7 | 76% | 13% | 26% |
| HD1-17 | Vect Cont | 1559-17-11 | 41.9 | 4.7 | 1.7 | 75% | 13% | 26% |
| HD1-14 | Vect Cont | 1559-17-11 | 41.8 | 4.8 | 1.7 | 75% | 13% | 26% |
| HD1-10 | Vect Cont | 1559-17-11 | 43.5 | 4.7 | 1.6 | 75% | 13% | 26% |
| HD1-18 | Vect Cont | 1559-17-11 | 42.6 | 4.7 | 1.6 | 75% | 13% | 26% |
| HD1-11 | Vect Cont | 1559-17-11 | 42.9 | 4.4 | 1.6 | 74% | 12% | 27% |
| Top5 Avg. | | | 41.3 | 6.3 | 2.9 | 76% | 18% | 31% |
| 1671-8 | GmMBOAT1 | 1559-17-11 | 49.8 | 2.5 | 7.2 | 82% | 16% | 75% |
| 1671-10 | GmMBOAT1 | 1559-17-11 | 50.3 | 2.4 | 7.1 | 82% | 16% | 75% |
| 1671-5 | GmMBOAT1 | 1559-17-11 | 48.6 | 2.3 | 6.7 | 79% | 16% | 74% |
| 1671-12 | GmMBOAT1 | 1559-17-11 | 48.0 | 2.2 | 6.3 | 79% | 15% | 75% |
| 1671-3 | GmMBOAT1 | 1559-17-11 | 47.5 | 1.0 | 5.8 | 77% | 12% | 85% |
| 1671-2 | GmMBOAT1 | 1559-17-11 | 52.2 | 3.1 | 5.6 | 84% | 14% | 65% |
| 1671-6 | GmMBOAT1 | 1559-17-11 | 48.3 | 2.8 | 5.6 | 81% | 15% | 66% |
| 1671-14 | GmMBOAT1 | 1559-17-11 | 51.6 | 2.6 | 4.5 | 81% | 12% | 64% |
| 1671-1 | GmMBOAT1 | 1559-17-11 | 40.4 | 6.6 | 2.9 | 76% | 19% | 31% |
| 1671-16 | GmMBOAT1 | 1559-17-11 | 41.9 | 6.8 | 2.4 | 76% | 18% | 26% |
| 1671-13 | GmMBOAT1 | 1559-17-11 | 42.6 | 5.3 | 2.2 | 74% | 15% | 29% |
| 1671-18 | GmMBOAT1 | 1559-17-11 | 43.0 | 6.0 | 2.1 | 76% | 16% | 26% |
| 1671-17 | GmMBOAT1 | 1559-17-11 | 41.3 | 5.2 | 2.1 | 75% | 15% | 29% |
| 1671-9 | GmMBOAT1 | 1559-17-11 | 42.0 | 5.7 | 2.1 | 76% | 16% | 27% |
| 1671-7 | GmMBOAT1 | 1559-17-11 | 41.1 | 5.5 | 2.0 | 75% | 16% | 27% |
| 1671-4 | GmMBOAT1 | 1559-17-11 | 42.1 | 5.0 | 1.9 | 75% | 14% | 28% |
| 1671-15 | GmMBOAT1 | 1559-17-11 | 42.6 | 5.3 | 1.9 | 75% | 14% | 26% |
| 1671-11 | GmMBOAT1 | 1559-17-11 | 42.6 | 4.7 | 1.8 | 75% | 13% | 28% |
| Top5 Avg. | | | 48.9 | 2.1 | 6.6 | 80% | 15% | 77% |
| 1672-14 | GmMBOAT2 | 1559-17-11 | 49.0 | 2.6 | 10.2 | 83% | 21% | 78% |
| 1672-9 | GmMBOAT2 | 1559-17-11 | 45.1 | 2.3 | 9.8 | 81% | 21% | 81% |
| 1672-8 | GmMBOAT2 | 1559-17-11 | 46.5 | 3.9 | 9.4 | 84% | 22% | 71% |
| 1672-16 | GmMBOAT2 | 1559-17-11 | 45.9 | 3.1 | 9.0 | 80% | 21% | 75% |
| 1672-1 | GmMBOAT2 | 1559-17-11 | 44.9 | 2.6 | 7.1 | 75% | 18% | 73% |
| 1672-18 | GmMBOAT2 | 1559-17-11 | 45.3 | 3.3 | 7.0 | 80% | 18% | 68% |
| 1672-12 | GmMBOAT2 | 1559-17-11 | 48.6 | 2.1 | 6.9 | 82% | 16% | 76% |
| 1672-2 | GmMBOAT2 | 1559-17-11 | 46.8 | 3.7 | 6.3 | 82% | 18% | 63% |
| 1672-11 | GmMBOAT2 | 1559-17-11 | 46.6 | 3.4 | 6.0 | 80% | 17% | 64% |
| 1672-13 | GmMBOAT2 | 1559-17-11 | 48.0 | 2.6 | 5.5 | 80% | 14% | 68% |
| 1672-15 | GmMBOAT2 | 1559-17-11 | 46.1 | 3.1 | 5.1 | 79% | 15% | 62% |
| 1672-5 | GmMBOAT2 | 1559-17-11 | 48.7 | 3.1 | 4.9 | 80% | 14% | 62% |
| 1672-7 | GmMBOAT2 | 1559-17-11 | 46.4 | 3.0 | 3.5 | 78% | 12% | 54% |
| 1672-10 | GmMBOAT2 | 1559-17-11 | 41.8 | 6.4 | 2.4 | 78% | 17% | 27% |
| 1672-3 | GmMBOAT2 | 1559-17-11 | 43.0 | 6.1 | 2.3 | 77% | 16% | 27% |
| 1672-17 | GmMBOAT2 | 1559-17-11 | 41.1 | 5.5 | 2.2 | 75% | 16% | 28% |
| 1672-6 | GmMBOAT2 | 1559-17-11 | 43.7 | 5.5 | 1.8 | 76% | 14% | 25% |
| 1672-4 | GmMBOAT2 | 1559-17-11 | 43.4 | 5.1 | 1.7 | 75% | 14% | 25% |
| Top5 Avg. | | | 46.3 | 2.9 | 9.1 | 81% | 21% | 76% |
| 1673-16 | CoMBOAT | 1559-17-11 | 40.7 | 6.1 | 6.6 | 80% | 24% | 52% |
| 1673-11 | CoMBOAT | 1559-17-11 | 42.3 | 4.0 | 6.2 | 75% | 19% | 61% |
| 1673-10 | CoMBOAT | 1559-17-11 | 37.3 | 0.2 | 4.6 | 72% | 11% | 97% |
| 1673-3 | CoMBOAT | 1559-17-11 | 36.4 | 0.2 | 4.4 | 71% | 11% | 97% |
| 1673-2 | CoMBOAT | 1559-17-11 | 36.9 | 0.1 | 4.2 | 71% | 11% | 97% |
| 1673-12 | CoMBOAT | 1559-17-11 | 44.0 | 5.0 | 3.8 | 78% | 17% | 43% |
| 1673-15 | CoMBOAT | 1559-17-11 | 39.9 | 7.6 | 3.7 | 78% | 22% | 33% |
| 1673-17 | CoMBOAT | 1559-17-11 | 38.7 | 7.5 | 3.1 | 76% | 21% | 29% |
| 1673-8 | CoMBOAT | 1559-17-11 | 40.0 | 7.4 | 3.1 | 76% | 21% | 29% |
| 1673-6 | CoMBOAT | 1559-17-11 | 41.9 | 7.6 | 2.8 | 78% | 20% | 27% |
| 1673-5 | CoMBOAT | 1559-17-11 | 41.5 | 6.9 | 2.7 | 77% | 19% | 28% |
| 1673-4 | CoMBOAT | 1559-17-11 | 40.4 | 6.0 | 2.2 | 74% | 17% | 27% |
| 1673-1 | CoMBOAT | 1559-17-11 | 40.9 | 5.8 | 2.2 | 75% | 16% | 27% |
| 1673-7 | CoMBOAT | 1559-17-11 | 40.7 | 6.0 | 2.2 | 75% | 17% | 26% |
| 1673-13 | CoMBOAT | 1559-17-11 | 41.6 | 5.3 | 2.1 | 75% | 15% | 28% |

TABLE 64-continued

Fatty acid profile of T2 seed from events expressing MBOATs in DGLA/ETA-expressing transgenic event 1559-17-11 (MaD6des/MaD6Elo)
T2 seed for pKR1559 (MaD6Des, MaElo) background event transformed with various MBOATs

| | | | | | | | | |
|---|---|---|---|---|---|---|---|---|
| 1673-9 | CoMBOAT | 1559-17-11 | 42.5 | 6.1 | 2.1 | 76% | 16% | 25% |
| 1673-18 | CoMBOAT | 1559-17-11 | 41.8 | 5.4 | 2.0 | 75% | 15% | 27% |
| 1673-14 | CoMBOAT | 1559-17-11 | 42.8 | 4.8 | 1.6 | 75% | 13% | 25% |
| Top5 Avg. | | | 38.7 | 2.1 | 5.2 | 74% | 15% | 81% |
| 1674-15 | McMBOAT | 1559-17-11 | 35.8 | 10.6 | 7.7 | 80% | 34% | 42% |
| 1674-11 | McMBOAT | 1559-17-11 | 47.8 | 3.0 | 7.4 | 81% | 18% | 71% |
| 1674-6 | McMBOAT | 1559-17-11 | 45.9 | 3.6 | 7.3 | 80% | 19% | 67% |
| 1674-8 | McMBOAT | 1559-17-11 | 47.0 | 3.8 | 6.8 | 82% | 18% | 64% |
| 1674-1 | McMBOAT | 1559-17-11 | 44.6 | 4.4 | 6.3 | 80% | 19% | 59% |
| 1674-9 | McMBOAT | 1559-17-11 | 49.9 | 2.3 | 6.0 | 80% | 14% | 72% |
| 1674-2 | McMBOAT | 1559-17-11 | 44.9 | 4.3 | 5.9 | 80% | 18% | 58% |
| 1674-3 | McMBOAT | 1559-17-11 | 46.2 | 3.6 | 4.2 | 78% | 14% | 54% |
| 1674-13 | McMBOAT | 1559-17-11 | 44.5 | 4.7 | 3.1 | 77% | 15% | 40% |
| 1674-14 | McMBOAT | 1559-17-11 | 42.9 | 7.0 | 2.7 | 78% | 18% | 28% |
| 1674-17 | McMBOAT | 1559-17-11 | 40.9 | 7.2 | 2.6 | 77% | 19% | 27% |
| 1674-18 | McMBOAT | 1559-17-11 | 41.8 | 7.1 | 2.4 | 77% | 18% | 25% |
| 1674-4 | McMBOAT | 1559-17-11 | 41.4 | 5.6 | 2.2 | 76% | 16% | 28% |
| 1674-16 | McMBOAT | 1559-17-11 | 42.8 | 6.3 | 2.2 | 76% | 16% | 26% |
| 1674-10 | McMBOAT | 1559-17-11 | 44.3 | 6.1 | 2.1 | 78% | 16% | 25% |
| 1674-12 | McMBOAT | 1559-17-11 | 44.0 | 5.7 | 2.0 | 77% | 15% | 26% |
| 1674-5 | McMBOAT | 1559-17-11 | 42.5 | 5.4 | 2.0 | 75% | 15% | 27% |
| 1674-7 | McMBOAT | 1559-17-11 | 42.1 | 4.7 | 1.7 | 74% | 13% | 26% |
| Top5 Avg. | | | 44.2 | 5.1 | 7.1 | 80% | 22% | 61% |
| 1845-2 | EuphMBOAT | 1559-17-11-8 | 32.3 | 10.8 | 8.6 | 81% | 38% | 45% |
| 1845-1 | EuphMBOAT | 1559-17-11-8 | 39.0 | 5.4 | 6.5 | 77% | 23% | 55% |
| 1845-13 | EuphMBOAT | 1559-17-11-8 | 37.3 | 7.9 | 5.9 | 78% | 27% | 43% |
| 1845-9 | EuphMBOAT | 1559-17-11-8 | 39.3 | 5.0 | 5.9 | 76% | 22% | 54% |
| 1845-10 | EuphMBOAT | 1559-17-11-8 | 39.8 | 5.7 | 5.4 | 78% | 22% | 49% |
| 1845-7 | EuphMBOAT | 1559-17-11-8 | 37.6 | 6.8 | 5.3 | 76% | 24% | 44% |
| 1845-6 | EuphMBOAT | 1559-17-11-8 | 37.3 | 8.2 | 4.5 | 78% | 25% | 35% |
| 1845-8 | EuphMBOAT | 1559-17-11-8 | 39.2 | 6.2 | 3.7 | 76% | 20% | 37% |
| 1845-14 | EuphMBOAT | 1559-17-11-8 | 40.9 | 5.9 | 3.6 | 78% | 19% | 38% |
| 1845-4 | EuphMBOAT | 1559-17-11-8 | 39.9 | 5.6 | 3.4 | 76% | 18% | 38% |
| 1845-12 | EuphMBOAT | 1559-17-11-8 | 38.9 | 6.7 | 2.5 | 74% | 19% | 27% |
| Top5 Avg. | | | 37.5 | 6.9 | 6.5 | 78% | 26% | 49% |

TABLE 65

Fatty acid profile of T2 seed from events expressing MBOATs in EDA/ERA-expressing transgenic event 926-5-4-1 (EgD9Elo)
T2 seed for pKR926 (EgD9Elo) background event transformed with various MBOATs

| Event # | MBOAT | Bkgrnd | % Oil | 16:0 | 18:0 | 18:1 | 18:2 | GLA | 18:3 | STA | 20:0 |
|---|---|---|---|---|---|---|---|---|---|---|---|
| | | 926-5-4-1 | | 8.8 | 2.9 | 12.2 | 27.5 | | 12.1 | | 1.4 |
| HD1-11 | ALS | 926-5-4-1 | 35.3 | 7.6 | 3.4 | 16.0 | 26.2 | 0.0 | 11.4 | 0.0 | 2.0 |
| HD1-3 | ALS | 926-5-4-1 | 34.7 | 8.1 | 3.1 | 16.9 | 28.3 | 0.0 | 11.8 | 0.0 | 2.0 |
| HD1-9 | ALS | 926-5-4-1 | 28 | 7.0 | 2.9 | 18.2 | 26.2 | 0.0 | 13.5 | 0.0 | 2.2 |
| HD1-1 | ALS | 926-5-4-1 | 35 | 7.4 | 3.3 | 16.8 | 29.0 | 0.0 | 13.1 | 0.0 | 2.1 |
| HD1-2 | ALS | 926-5-4-1 | 32.3 | 6.6 | 2.9 | 15.2 | 23.8 | 0.0 | 10.7 | 0.0 | 1.5 |
| HD1-6 | ALS | 926-5-4-1 | 32.1 | 6.2 | 2.8 | 15.3 | 23.0 | 0.2 | 11.4 | 0.0 | 1.7 |
| HD1-5 | ALS | 926-5-4-1 | 33.3 | 7.9 | 3.1 | 17.0 | 29.1 | 0.0 | 13.8 | 0.0 | 2.2 |
| HD1-7 | ALS | 926-5-4-1 | 34.9 | 7.7 | 3.3 | 16.9 | 28.9 | 0.0 | 14.6 | 0.0 | 2.2 |
| HD1-4 | ALS | 926-5-4-1 | 31.1 | 6.3 | 2.6 | 15.2 | 23.8 | 0.0 | 12.1 | 0.0 | 1.6 |
| HD1-10 | ALS | 926-5-4-1 | 34.6 | 6.4 | 2.9 | 16.9 | 24.5 | 0.2 | 12.2 | 0.0 | 1.7 |
| HD1-8 | ALS | 926-5-4-1 | | 6.7 | 2.8 | 15.3 | 25.6 | 0.0 | 12.9 | 0.0 | 1.7 |
| HD1-12 | ALS | 926-5-4-1 | 37.3 | 6.6 | 2.9 | 18.5 | 28.7 | 0.1 | 17.8 | 0.0 | 1.9 |
| Top5 Avg. | | | 33 | 7.3 | 3.1 | 16.6 | 26.7 | 0.0 | 12.1 | 0.0 | 2.0 |
| pKR1672-8 | GmMBOAT2 | 926-5-4-1 | 27.7 | 6.7 | 3.1 | 13.1 | 20.7 | 0.0 | 8.1 | 1.3 | 3.0 |
| pKR1672-4 | GmMBOAT2 | 926-5-4-1 | 24.5 | 7.4 | 3.8 | 13.2 | 20.2 | 0.0 | 6.2 | 1.2 | 3.4 |
| pKR1672-1 | GmMBOAT2 | 926-5-4-1 | 30.6 | 6.5 | 2.8 | 14.7 | 19.8 | 0.0 | 10.2 | 0.0 | 1.2 |
| pKR1672-9 | GmMBOAT2 | 926-5-4-1 | 40.1 | 5.6 | 2.6 | 14.0 | 19.4 | 0.0 | 10.8 | 0.8 | 0.8 |
| pKR1672-2 | GmMBOAT2 | 926-5-4-1 | 30.3 | 7.5 | 4.0 | 13.4 | 21.2 | 0.0 | 7.0 | 0.0 | 3.7 |
| pKR1672-6 | GmMBOAT2 | 926-5-4-1 | 30 | 6.7 | 3.1 | 13.4 | 22.8 | 0.0 | 7.7 | 1.3 | 3.1 |
| pKR1672-7 | GmMBOAT2 | 926-5-4-1 | 31.1 | 6.0 | 2.8 | 13.7 | 22.0 | 0.0 | 12.6 | 0.0 | 1.0 |
| pKR1672-5 | GmMBOAT2 | 926-5-4-1 | 33 | 5.9 | 2.9 | 14.3 | 22.9 | 0.0 | 12.7 | 0.7 | 1.1 |
| pKR1672-3 | GmMBOAT2 | 926-5-4-1 | 35.6 | 6.3 | 2.5 | 14.3 | 27.3 | 0.0 | 16.9 | 0.0 | 1.0 |
| Top5 Avg. | | | 30.6 | 6.7 | 3.3 | 13.7 | 20.3 | 0.0 | 8.5 | 0.7 | 2.5 |
| pKR1673-3 | CoMBOAT | 926-5-4-1 | 35.7 | 7.3 | 2.6 | 10.2 | 24.0 | 0.0 | 14.7 | 0.0 | 1.3 |
| pKR1673-1 | CoMBOAT | 926-5-4-1 | 37.7 | 7.2 | 2.7 | 10.1 | 24.3 | 0.0 | 15.2 | 0.0 | 1.3 |
| pKR1673-5 | CoMBOAT | 926-5-4-1 | 41.3 | 7.4 | 3.2 | 11.3 | 25.0 | 0.0 | 13.4 | 0.0 | 1.4 |
| pKR1673-2 | CoMBOAT | 926-5-4-1 | 38.7 | 7.7 | 3.0 | 13.2 | 27.7 | 0.0 | 12.7 | 0.0 | 1.5 |
| pKR1673-6 | CoMBOAT | 926-5-4-1 | 40.8 | 8.2 | 3.1 | 14.2 | 28.4 | 0.0 | 13.1 | 0.0 | 1.5 |

TABLE 65-continued

Fatty acid profile of T2 seed from events expressing MBOATs in
EDA/ERA-expressing transgenic event 926-5-4-1 (EgD9Elo)
T2 seed for pKR926 (EgD9Elo) background event transformed with various MBOATs

| Event # | MBOAT | Bkgrnd | | | | | | | | | |
|---|---|---|---|---|---|---|---|---|---|---|---|
| pKR1673-4 | CoMBOAT | 926-5-4-1 | 40.6 | 8.1 | 3.1 | 14.0 | 28.4 | 0.0 | 13.8 | 0.0 | 1.5 |
| Top5 Avg. | | | 38.8 | 7.6 | 2.9 | 11.8 | 25.9 | 0.0 | 13.8 | 0.0 | 1.4 |
| pKR1674-10 | McMBOAT | 926-5-4-1 | 29.7 | 6.3 | 2.9 | 14.0 | 20.2 | 0.0 | 8.3 | 0.3 | 1.4 |
| pKR1674-13 | McMBOAT | 926-5-4-1 | 32.6 | 6.6 | 2.9 | 13.0 | 21.3 | 0.0 | 7.6 | 1.1 | 2.8 |
| pKR1674-12 | McMBOAT | 926-5-4-1 | 31.7 | 5.9 | 3.3 | 14.3 | 19.8 | 0.0 | 9.7 | 0.7 | 1.3 |
| pKR1674-1 | McMBOAT | 926-5-4-1 | 30.6 | 6.5 | 3.1 | 12.6 | 21.2 | 0.0 | 8.9 | 2.5 | 2.9 |
| pKR1674-15 | McMBOAT | 926-5-4-1 | 36 | 6.8 | 2.9 | 12.9 | 23.3 | 0.0 | 8.5 | 0.8 | 2.4 |
| pKR1674-4 | McMBOAT | 926-5-4-1 | 27.4 | 6.7 | 2.9 | 11.4 | 21.6 | 0.0 | 10.7 | 0.9 | 1.2 |
| pKR1674-16 | McMBOAT | 926-5-4-1 | 22.3 | 6.6 | 2.9 | 12.2 | 22.4 | 0.0 | 11.8 | 0.6 | 1.2 |
| pKR1674-3 | McMBOAT | 926-5-4-1 | 35.2 | 6.9 | 3.1 | 13.7 | 22.1 | 0.0 | 8.0 | 1.3 | 2.9 |
| pKR1674-7 | McMBOAT | 926-5-4-1 | 32.2 | 6.3 | 2.7 | 13.4 | 22.4 | 0.0 | 9.3 | 2.3 | 2.7 |
| pKR1674-11 | McMBOAT | 926-5-4-1 | 30.9 | 7.2 | 3.0 | 13.1 | 23.1 | 0.0 | 7.5 | 0.9 | 2.3 |
| pKR1674-6 | McMBOAT | 926-5-4-1 | 33.2 | 6.7 | 2.9 | 14.2 | 22.6 | 0.0 | 11.3 | 0.0 | 1.2 |
| pKR1674-9 | McMBOAT | 926-5-4-1 | 32.4 | 7.3 | 3.0 | 13.4 | 22.5 | 0.0 | 8.9 | 1.4 | 2.8 |
| pKR1674-8 | McMBOAT | 926-5-4-1 | 33.6 | 6.1 | 2.8 | 14.6 | 22.7 | 0.0 | 11.6 | 0.5 | 1.3 |
| pKR1674-5 | McMBOAT | 926-5-4-1 | 31.1 | 7.5 | 3.1 | 15.9 | 22.8 | 0.0 | 8.2 | 2.2 | 3.7 |
| pKR1674-14 | McMBOAT | 926-5-4-1 | 28.6 | 6.4 | 2.6 | 14.0 | 25.5 | 0.0 | 13.9 | 0.7 | 1.2 |
| pKR1674-2 | McMBOAT | 926-5-4-1 | 30.9 | 6.2 | 2.7 | 16.7 | 23.9 | 0.0 | 13.3 | 0.7 | 1.1 |
| Top5 Avg. | | | 32.1 | 6.4 | 3.0 | 13.3 | 21.2 | 0.0 | 8.6 | 1.1 | 2.2 |
| pKR1845-5 | EuphMBOAT | 926-5-4-1 | 33.9 | 6.4 | 3.0 | 13.6 | 22.6 | 0.0 | 9.8 | 0.0 | 1.8 |
| pKR1845-10 | EuphMBOAT | 926-5-4-1 | 31.4 | 6.9 | 2.7 | 13.2 | 23.4 | 0.0 | 10.5 | 0.0 | 1.4 |
| pKR1845-9 | EuphMBOAT | 926-5-4-1 | 31.3 | 6.3 | 2.8 | 14.3 | 23.1 | 0.0 | 10.2 | 0.0 | 1.7 |
| pKR1845-8 | EuphMBOAT | 926-5-4-1 | 35.4 | 6.7 | 2.8 | 14.2 | 23.1 | 0.0 | 11.2 | 0.0 | 1.6 |
| pKR1845-6 | EuphMBOAT | 926-5-4-1 | 31.5 | 6.6 | 2.9 | 14.7 | 22.3 | 0.0 | 11.1 | 0.0 | 1.6 |
| pKR1845-1 | EuphMBOAT | 926-5-4-1 | 51.2 | 6.6 | 2.7 | 15.2 | 24.4 | 0.0 | 9.4 | 0.0 | 1.6 |
| pKR1845-3 | EuphMBOAT | 926-5-4-1 | 34.2 | 6.3 | 2.9 | 14.1 | 23.3 | 0.0 | 11.8 | 0.0 | 1.7 |
| pKR1845-11 | EuphMBOAT | 926-5-4-1 | 32 | 6.5 | 2.8 | 14.0 | 24.7 | 0.0 | 10.9 | 0.0 | 1.8 |
| pKR1845-4 | EuphMBOAT | 926-5-4-1 | 34.2 | 6.6 | 2.8 | 14.6 | 24.3 | 0.0 | 11.9 | 0.0 | 1.6 |
| pKR1845-7 | EuphMBOAT | 926-5-4-1 | 35.1 | 6.5 | 3.0 | 13.6 | 24.6 | 0.0 | 12.8 | 0.0 | 1.7 |
| pKR1845-2 | EuphMBOAT | 926-5-4-1 | 33 | 7.2 | 2.7 | 17.0 | 29.7 | 0.0 | 16.2 | 0.0 | 1.8 |
| Top5 Avg. | | | 32.7 | 6.6 | 2.8 | 14.0 | 22.9 | 0.0 | 10.5 | 0.0 | 1.6 |

| Event # | MBOAT | Bkgrnd | 20:1 | EDA | ERA | LA + ALA | EDA + ERA | % D12Des | % D9Elo |
|---|---|---|---|---|---|---|---|---|---|
| | | 926-5-4-1 | 13.5 | 15.1 | 6.5 | 39.6 | 21.5 | 83% | 35% |
| HD1-11 | ALS | 926-5-4-1 | 1.7 | 21.9 | 9.3 | 37.6 | 31.2 | 81% | 45% |
| HD1-3 | ALS | 926-5-4-1 | 1.9 | 19.7 | 7.8 | 40.1 | 27.6 | 80% | 41% |
| HD1-9 | ALS | 926-5-4-1 | 3.0 | 19.1 | 7.9 | 39.7 | 27.0 | 79% | 41% |
| HD1-1 | ALS | 926-5-4-1 | 1.8 | 18.8 | 7.9 | 42.1 | 26.6 | 80% | 39% |
| HD1-2 | ALS | 926-5-4-1 | 14.0 | 18.1 | 7.3 | 34.5 | 25.4 | 80% | 42% |
| HD1-6 | ALS | 926-5-4-1 | 14.3 | 17.6 | 7.4 | 34.4 | 25.1 | 80% | 42% |
| HD1-5 | ALS | 926-5-4-1 | 1.9 | 17.6 | 7.2 | 43.0 | 24.8 | 80% | 37% |
| HD1-7 | ALS | 926-5-4-1 | 1.9 | 17.2 | 7.4 | 43.4 | 24.7 | 80% | 36% |
| HD1-4 | ALS | 926-5-4-1 | 15.1 | 16.7 | 6.6 | 35.9 | 23.3 | 80% | 39% |
| HD1-10 | ALS | 926-5-4-1 | 15.2 | 14.5 | 5.6 | 36.7 | 20.0 | 77% | 35% |
| HD1-8 | ALS | 926-5-4-1 | 16.5 | 13.2 | 5.4 | 38.5 | 18.5 | 79% | 32% |
| HD1-12 | ALS | 926-5-4-1 | 21.0 | 2.0 | 0.5 | 46.4 | 2.5 | 73% | 5% |
| Top5 Avg. | | | 4.5 | 19.5 | 8.0 | 38.8 | 27.6 | 80% | 42% |
| pKR1672-8 | GmMBOAT2 | 926-5-4-1 | 6.6 | 28.1 | 9.3 | 28.7 | 37.4 | 83% | 57% |
| pKR1672-4 | GmMBOAT2 | 926-5-4-1 | 7.4 | 29.2 | 7.8 | 26.4 | 37.1 | 83% | 58% |
| pKR1672-1 | GmMBOAT2 | 926-5-4-1 | 9.9 | 26.8 | 8.1 | 30.0 | 34.9 | 82% | 54% |
| pKR1672-9 | GmMBOAT2 | 926-5-4-1 | 8.5 | 25.8 | 9.0 | 30.2 | 34.8 | 82% | 54% |
| pKR1672-2 | GmMBOAT2 | 926-5-4-1 | 8.4 | 27.1 | 7.6 | 28.3 | 34.7 | 83% | 55% |
| pKR1672-6 | GmMBOAT2 | 926-5-4-1 | 7.4 | 26.7 | 7.8 | 30.5 | 34.5 | 83% | 53% |
| pKR1672-7 | GmMBOAT2 | 926-5-4-1 | 7.3 | 24.2 | 8.5 | 34.6 | 32.7 | 83% | 49% |
| pKR1672-5 | GmMBOAT2 | 926-5-4-1 | 9.8 | 21.8 | 7.8 | 35.6 | 29.6 | 82% | 45% |
| pKR1672-3 | GmMBOAT2 | 926-5-4-1 | 11.4 | 15.1 | 5.2 | 44.2 | 20.3 | 82% | 31% |
| Top5 Avg. | | | 8.2 | 27.4 | 8.4 | 28.7 | 35.8 | 83% | 55% |
| pKR1673-3 | CoMBOAT | 926-5-4-1 | 11.0 | 18.9 | 10.1 | 38.6 | 29.0 | 87% | 43% |
| pKR1673-1 | CoMBOAT | 926-5-4-1 | 11.5 | 17.8 | 9.8 | 39.5 | 27.7 | 87% | 41% |
| pKR1673-5 | CoMBOAT | 926-5-4-1 | 11.6 | 17.9 | 8.8 | 38.4 | 26.7 | 85% | 41% |
| pKR1673-2 | CoMBOAT | 926-5-4-1 | 14.4 | 13.4 | 6.2 | 40.5 | 19.6 | 82% | 33% |
| pKR1673-6 | CoMBOAT | 926-5-4-1 | 14.6 | 11.6 | 5.3 | 41.5 | 16.8 | 80% | 29% |
| pKR1673-4 | CoMBOAT | 926-5-4-1 | 14.9 | 11.0 | 5.1 | 42.2 | 16.1 | 81% | 28% |
| Top5 Avg. | | | 12.6 | 15.9 | 8.0 | 39.7 | 24.0 | 84% | 37% |
| pKR1674-10 | McMBOAT | 926-5-4-1 | 6.6 | 31.0 | 9.1 | 28.5 | 40.1 | 83% | 58% |
| pKR1674-13 | McMBOAT | 926-5-4-1 | 6.5 | 29.5 | 8.7 | 28.9 | 38.2 | 84% | 57% |
| pKR1674-12 | McMBOAT | 926-5-4-1 | 8.6 | 27.1 | 9.3 | 29.5 | 36.4 | 82% | 55% |
| pKR1674-1 | McMBOAT | 926-5-4-1 | 7.0 | 26.4 | 8.8 | 30.1 | 35.2 | 84% | 54% |
| pKR1674-15 | McMBOAT | 926-5-4-1 | 7.6 | 26.5 | 8.4 | 31.8 | 34.9 | 84% | 52% |
| pKR1674-4 | McMBOAT | 926-5-4-1 | 8.0 | 25.8 | 8.8 | 32.3 | 34.5 | 85% | 52% |
| pKR1674-16 | McMBOAT | 926-5-4-1 | 8.4 | 25.1 | 8.8 | 34.2 | 33.9 | 85% | 50% |
| pKR1674-3 | McMBOAT | 926-5-4-1 | 8.6 | 25.4 | 8.1 | 30.0 | 33.5 | 82% | 53% |
| pKR1674-7 | McMBOAT | 926-5-4-1 | 8.9 | 24.0 | 8.0 | 31.7 | 32.0 | 83% | 50% |
| pKR1674-11 | McMBOAT | 926-5-4-1 | 11.4 | 22.8 | 8.6 | 30.7 | 31.4 | 83% | 51% |

TABLE 65-continued

Fatty acid profile of T2 seed from events expressing MBOATs in
EDA/ERA-expressing transgenic event 926-5-4-1 (EgD9Elo)
T2 seed for pKR926 (EgD9Elo) background event transformed with various MBOATs

| | | | | | | | | | |
|---|---|---|---|---|---|---|---|---|---|
| pKR1674-6 | McMBOAT | 926-5-4-1 | 10.1 | 23.8 | 7.0 | 34.0 | 30.9 | 82% | 48% |
| pKR1674-9 | McMBOAT | 926-5-4-1 | 10.3 | 22.6 | 7.7 | 31.4 | 30.3 | 82% | 49% |
| pKR1674-8 | McMBOAT | 926-5-4-1 | 10.8 | 22.1 | 7.5 | 34.2 | 29.6 | 81% | 46% |
| pKR1674-5 | McMBOAT | 926-5-4-1 | 12.0 | 18.0 | 6.6 | 31.0 | 24.7 | 78% | 44% |
| pKR1674-14 | McMBOAT | 926-5-4-1 | 11.1 | 18.4 | 6.1 | 39.4 | 24.5 | 82% | 38% |
| pKR1674-2 | McMBOAT | 926-5-4-1 | 12.7 | 16.7 | 6.0 | 37.2 | 22.7 | 78% | 38% |
| Top5 Avg. | | | 7.3 | 28.1 | 8.9 | 29.8 | 37.0 | 83% | 55% |
| pKR1845-5 | EuphMBOAT | 926-5-4-1 | 11.1 | 22.8 | 9.1 | 32.4 | 31.8 | 83% | 50% |
| pKR1845-10 | EuphMBOAT | 926-5-4-1 | 12.0 | 21.2 | 8.6 | 33.9 | 29.8 | 83% | 47% |
| pKR1845-9 | EuphMBOAT | 926-5-4-1 | 12.9 | 21.1 | 7.7 | 33.2 | 28.8 | 81% | 46% |
| pKR1845-8 | EuphMBOAT | 926-5-4-1 | 12.6 | 19.8 | 8.0 | 34.3 | 27.8 | 81% | 45% |
| pKR1845-6 | EuphMBOAT | 926-5-4-1 | 13.1 | 19.9 | 7.9 | 33.4 | 27.8 | 81% | 45% |
| pKR1845-1 | EuphMBOAT | 926-5-4-1 | 13.0 | 19.8 | 7.4 | 33.8 | 27.2 | 80% | 45% |
| pKR1845-3 | EuphMBOAT | 926-5-4-1 | 13.3 | 18.6 | 8.0 | 35.1 | 26.6 | 81% | 43% |
| pKR1845-11 | EuphMBOAT | 926-5-4-1 | 12.9 | 19.4 | 6.9 | 35.7 | 26.4 | 82% | 43% |
| pKR1845-4 | EuphMBOAT | 926-5-4-1 | 14.1 | 17.4 | 6.7 | 36.2 | 24.1 | 80% | 40% |
| pKR1845-7 | EuphMBOAT | 926-5-4-1 | 15.5 | 15.6 | 6.9 | 37.3 | 22.4 | 81% | 38% |
| pKR1845-2 | EuphMBOAT | 926-5-4-1 | 19.1 | 4.9 | 1.3 | 45.9 | 6.3 | 75% | 12% |
| Top5 Avg. | | | 12.3 | 20.9 | 8.3 | 33.4 | 29.2 | 82% | 47% |

TABLE 66

Fatty acid profile of T2 seed from events expressing MBOATs in
EDA/ERA-expressing transgenic event 1191-4-11 (EaD9Elo)
T2 seed for pKR1191(EaD9Elo) background event transformed with various MBOATs

| Event # | MBOAT | Bkgrnd | % Oil | 16:0 | 18:0 | 18:1 | 18:2 | GLA | 18:3 | STA | 20:0 |
|---|---|---|---|---|---|---|---|---|---|---|---|
| | | 1191-4-11 | | 7.3 | 3.2 | 12.4 | 24.6 | 0.0 | 11.5 | 0.0 | 1.4 |
| HD1-4 | Vect Cont | 1191-4-11 | 34.5 | 7.7 | 2.7 | 12.2 | 21.0 | 0.0 | 9.7 | 0.0 | 1.1 |
| HD1-11 | Vect Cont | 1191-4-11 | 29.5 | 8.1 | 2.4 | 11.6 | 21.7 | 0.0 | 9.5 | 0.0 | 1.2 |
| HD1-7 | Vect Cont | 1191-4-11 | 34.8 | 8.0 | 2.6 | 11.0 | 21.4 | 0.0 | 10.4 | 0.0 | 1.2 |
| HD1-1 | Vect Cont | 1191-4-11 | 32.6 | 8.5 | 2.5 | 9.5 | 21.9 | 0.0 | 11.7 | 0.0 | 1.2 |
| HD1-8 | Vect Cont | 1191-4-11 | 33.1 | 7.5 | 2.6 | 11.2 | 22.2 | 0.0 | 10.8 | 0.0 | 1.1 |
| HD1-2 | Vect Cont | 1191-4-11 | 32.9 | 6.9 | 2.5 | 11.5 | 21.6 | 0.0 | 11.8 | 0.0 | 1.1 |
| HD1-10 | Vect Cont | 1191-4-11 | 30.4 | 6.8 | 2.4 | 11.9 | 20.9 | 0.0 | 13.3 | 0.0 | 1.2 |
| HD1-5 | Vect Cont | 1191-4-11 | 38.3 | 8.4 | 2.8 | 11.7 | 22.0 | 0.0 | 11.6 | 0.0 | 1.2 |
| HD1-12 | Vect Cont | 1191-4-11 | 37.3 | 7.7 | 2.8 | 11.1 | 23.0 | 0.0 | 12.1 | 0.0 | 1.1 |
| HD1-3 | Vect Cont | 1191-4-11 | 27.5 | 8.4 | 2.6 | 10.6 | 23.1 | 0.0 | 12.5 | 0.0 | 1.2 |
| HD1-13 | Vect Cont | 1191-4-11 | 27.9 | 7.7 | 2.6 | 10.1 | 22.1 | 0.0 | 13.1 | 0.0 | 1.3 |
| HD1-6 | Vect Cont | 1191-4-11 | 32.1 | 7.4 | 2.4 | 12.0 | 21.6 | 0.0 | 14.3 | 0.0 | 1.0 |
| HD1-9 | Vect Cont | 1191-4-11 | 32.7 | 8.9 | 2.9 | 12.7 | 25.8 | 0.0 | 11.3 | 0.0 | 1.3 |
| Top5 Avg. | | | 32.9 | 8.0 | 2.6 | 11.1 | 21.6 | 0.0 | 10.4 | 0.0 | 1.2 |
| 1673-9 | CoMBOAT | 1191-4-11 | 30.5 | 8.4 | 2.8 | 10.8 | 17.8 | 0.0 | 8.4 | 0.0 | 1.1 |
| 1673-14 | CoMBOAT | 1191-4-11 | 26.9 | 7.2 | 2.6 | 11.4 | 17.7 | 0.0 | 8.3 | 0.0 | 1.0 |
| 1673-1 | CoMBOAT | 1191-4-11 | 29.5 | 7.6 | 2.4 | 9.1 | 18.7 | 0.0 | 10.0 | 0.0 | 1.3 |
| 1673-16 | CoMBOAT | 1191-4-11 | 37.6 | 7.2 | 2.6 | 11.2 | 18.4 | 0.0 | 9.4 | 0.0 | 1.1 |
| 1673-12 | CoMBOAT | 1191-4-11 | 37 | 6.9 | 2.4 | 11.4 | 18.5 | 0.0 | 8.9 | 0.0 | 1.1 |
| 1673-7 | CoMBOAT | 1191-4-11 | 34.6 | 8.3 | 2.9 | 12.2 | 19.4 | 0.0 | 9.1 | 0.0 | 1.1 |
| 1673-11 | CoMBOAT | 1191-4-11 | 34.3 | 7.8 | 2.2 | 10.7 | 19.1 | 0.0 | 9.5 | 0.0 | 1.2 |
| 1673-8 | CoMBOAT | 1191-4-11 | 30.4 | 6.9 | 2.6 | 11.5 | 17.9 | 0.0 | 10.3 | 0.0 | 1.1 |
| 1673-6 | CoMBOAT | 1191-4-11 | 31.4 | 7.1 | 2.7 | 11.2 | 18.8 | 0.0 | 10.1 | 0.0 | 1.1 |
| 1673-10 | CoMBOAT | 1191-4-11 | 33.2 | 6.8 | 2.7 | 11.2 | 19.8 | 0.0 | 10.2 | 0.0 | 1.1 |
| 1673-5 | CoMBOAT | 1191-4-11 | 29.3 | 8.0 | 2.7 | 9.2 | 20.1 | 0.0 | 10.7 | 0.0 | 1.5 |
| 1673-17 | CoMBOAT | 1191-4-11 | 30.1 | 7.7 | 2.6 | 11.9 | 20.5 | 0.0 | 9.6 | 0.0 | 1.1 |
| 1673-2 | CoMBOAT | 1191-4-11 | 33.8 | 7.1 | 2.6 | 12.7 | 20.8 | 0.0 | 8.2 | 0.0 | 1.1 |
| 1673-3 | CoMBOAT | 1191-4-11 | 30.2 | 8.4 | 2.6 | 9.3 | 19.8 | 0.0 | 12.7 | 0.0 | 1.3 |
| 1673-13 | CoMBOAT | 1191-4-11 | 37.8 | 7.9 | 2.8 | 10.9 | 21.0 | 0.0 | 10.6 | 0.0 | 1.2 |
| 1673-4 | CoMBOAT | 1191-4-11 | 34.3 | 8.1 | 3.0 | 11.5 | 21.3 | 0.0 | 10.2 | 0.0 | 1.0 |
| 1673-15 | CoMBOAT | 1191-4-11 | 35.9 | 8.4 | 3.0 | 11.3 | 21.5 | 0.0 | 10.1 | 0.0 | 1.2 |
| Top5 Avg. | | | 32.3 | 7.5 | 2.6 | 10.8 | 18.2 | 0.0 | 9.0 | 0.0 | 1.1 |
| 1674-10 | McMBOAT | 1191-4-11 | 27.4 | 7.4 | 2.5 | 8.7 | 13.4 | 0.0 | 5.3 | 0.0 | 1.2 |
| 1674-2 | McMBOAT | 1191-4-11 | 24 | 7.7 | 2.4 | 8.9 | 13.9 | 0.0 | 5.5 | 0.0 | 1.3 |
| 1674-11 | McMBOAT | 1191-4-11 | 33.2 | 6.3 | 2.7 | 11.0 | 13.8 | 0.2 | 5.2 | 0.0 | 1.2 |
| 1674-14 | McMBOAT | 1191-4-11 | 36.2 | 7.9 | 2.2 | 8.8 | 14.9 | 0.0 | 6.7 | 0.0 | 1.2 |
| 1674-13 | McMBOAT | 1191-4-11 | 29.9 | 7.3 | 2.6 | 11.2 | 14.7 | 0.0 | 6.4 | 0.0 | 1.0 |
| 1674-9 | McMBOAT | 1191-4-11 | 36.4 | 7.8 | 2.7 | 12.7 | 15.2 | 0.0 | 5.6 | 0.0 | 0.9 |
| 1674-5 | McMBOAT | 1191-4-11 | 26.1 | 7.1 | 2.6 | 11.4 | 15.3 | 0.0 | 6.1 | 0.0 | 1.0 |
| 1674-7 | McMBOAT | 1191-4-11 | 39.7 | 7.6 | 2.5 | 10.8 | 15.1 | 0.0 | 6.6 | 0.0 | 1.0 |
| 1674-6 | McMBOAT | 1191-4-11 | 30.2 | 7.8 | 2.5 | 7.4 | 17.4 | 0.0 | 8.1 | 0.0 | 1.2 |
| 1674-4 | McMBOAT | 1191-4-11 | 31.8 | 8.1 | 2.8 | 11.2 | 18.0 | 0.0 | 7.8 | 0.0 | 1.1 |
| 1674-1 | McMBOAT | 1191-4-11 | 29.5 | 7.3 | 2.3 | 12.7 | 16.9 | 0.0 | 8.3 | 0.0 | 1.1 |
| 1674-12 | McMBOAT | 1191-4-11 | 33.2 | 8.1 | 2.6 | 9.3 | 19.7 | 0.0 | 7.5 | 0.0 | 1.2 |

TABLE 66-continued

Fatty acid profile of T2 seed from events expressing MBOATs in
EDA/ERA-expressing transgenic event 1191-4-11 (EaD9Elo)
T2 seed for pKR1191(EaD9Elo) background event transformed with various MBOATs

| 1674-15 | McMBOAT | 1191-4-11 | 30.1 | 7.9 | 2.5 | 14.2 | 16.6 | 0.0 | 8.3 | 0.0 | 1.0 |
| 1674-3 | McMBOAT | 1191-4-11 | 36.5 | 7.3 | 2.6 | 11.8 | 20.5 | 0.0 | 12.4 | 0.0 | 1.1 |
| 1674-8 | McMBOAT | 1191-4-11 | 26 | 8.3 | 2.9 | 13.4 | 24.5 | 0.0 | 11.9 | 0.0 | 1.2 |
| Top5 Avg. | | | 30.1 | 7.3 | 2.5 | 9.7 | 14.1 | 0.0 | 5.8 | 0.0 | 1.1 |

| Event # | MBOAT | Bkgrnd | 20:1 | EDA | ERA | LA + ALA | EDA + ERA | % D12Des | % D9Elo |
|---|---|---|---|---|---|---|---|---|---|
| | | 1191-4-11 | 14.2 | 16.9 | 8.4 | 36.1 | 25.4 | 83% | 41% |
| HD1-4 | Vect Cont | 1191-4-11 | 10.0 | 23.2 | 12.3 | 30.7 | 35.5 | 84% | 54% |
| HD1-11 | Vect Cont | 1191-4-11 | 8.8 | 23.4 | 12.1 | 31.2 | 35.5 | 85% | 53% |
| HD1-7 | Vect Cont | 1191-4-11 | 8.9 | 22.9 | 12.5 | 31.8 | 35.4 | 86% | 53% |
| HD1-1 | Vect Cont | 1191-4-11 | 9.2 | 21.5 | 12.8 | 33.6 | 34.3 | 88% | 50% |
| HD1-8 | Vect Cont | 1191-4-11 | 11.2 | 21.6 | 11.7 | 32.9 | 33.3 | 86% | 50% |
| HD1-2 | Vect Cont | 1191-4-11 | 11.8 | 21.0 | 11.7 | 33.4 | 32.7 | 85% | 49% |
| HD1-10 | Vect Cont | 1191-4-11 | 11.4 | 20.1 | 12.0 | 34.2 | 32.1 | 85% | 48% |
| HD1-5 | Vect Cont | 1191-4-11 | 9.2 | 20.1 | 11.6 | 33.5 | 31.8 | 85% | 49% |
| HD1-12 | Vect Cont | 1191-4-11 | 10.9 | 20.1 | 11.2 | 35.0 | 31.3 | 86% | 47% |
| HD1-3 | Vect Cont | 1191-4-11 | 9.8 | 19.2 | 11.5 | 35.7 | 30.7 | 86% | 46% |
| HD1-13 | Vect Cont | 1191-4-11 | 11.2 | 19.1 | 11.4 | 35.2 | 30.5 | 87% | 46% |
| HD1-6 | Vect Cont | 1191-4-11 | 11.4 | 18.4 | 11.5 | 35.9 | 29.9 | 85% | 45% |
| HD1-9 | Vect Cont | 1191-4-11 | 11.7 | 16.7 | 7.8 | 37.1 | 24.6 | 83% | 40% |
| Top5 Avg. | | | 9.6 | 22.5 | 12.3 | 32.1 | 34.8 | 86% | 52% |
| 1673-9 | CoMBOAT | 1191-4-11 | 5.8 | 29.6 | 15.4 | 26.2 | 45.0 | 87% | 63% |
| 1673-14 | CoMBOAT | 1191-4-11 | 7.9 | 29.6 | 14.3 | 26.0 | 44.0 | 86% | 63% |
| 1673-1 | CoMBOAT | 1191-4-11 | 7.8 | 28.1 | 14.9 | 28.7 | 43.0 | 89% | 60% |
| 1673-16 | CoMBOAT | 1191-4-11 | 8.6 | 27.1 | 14.4 | 27.8 | 41.5 | 86% | 60% |
| 1673-12 | CoMBOAT | 1191-4-11 | 9.2 | 27.6 | 13.9 | 27.4 | 41.5 | 86% | 60% |
| 1673-7 | CoMBOAT | 1191-4-11 | 6.3 | 27.2 | 13.6 | 28.4 | 40.9 | 85% | 59% |
| 1673-11 | CoMBOAT | 1191-4-11 | 7.6 | 26.4 | 14.3 | 28.6 | 40.7 | 87% | 59% |
| 1673-8 | CoMBOAT | 1191-4-11 | 9.7 | 25.4 | 14.5 | 28.2 | 39.9 | 86% | 59% |
| 1673-6 | CoMBOAT | 1191-4-11 | 9.2 | 25.8 | 14.0 | 28.9 | 39.8 | 86% | 58% |
| 1673-10 | CoMBOAT | 1191-4-11 | 10.1 | 25.1 | 13.1 | 30.0 | 38.1 | 86% | 56% |
| 1673-5 | CoMBOAT | 1191-4-11 | 9.1 | 24.3 | 13.3 | 30.8 | 37.5 | 88% | 55% |
| 1673-17 | CoMBOAT | 1191-4-11 | 8.0 | 25.4 | 12.0 | 30.1 | 37.5 | 85% | 55% |
| 1673-2 | CoMBOAT | 1191-4-11 | 10.2 | 25.4 | 11.8 | 29.0 | 37.3 | 84% | 56% |
| 1673-3 | CoMBOAT | 1191-4-11 | 8.8 | 22.9 | 14.1 | 32.5 | 37.0 | 88% | 53% |
| 1673-13 | CoMBOAT | 1191-4-11 | 8.6 | 23.7 | 13.2 | 31.6 | 37.0 | 86% | 54% |
| 1673-4 | CoMBOAT | 1191-4-11 | 9.1 | 23.4 | 12.2 | 31.6 | 35.6 | 85% | 53% |
| 1673-15 | CoMBOAT | 1191-4-11 | 8.6 | 23.6 | 11.4 | 31.5 | 35.0 | 85% | 53% |
| Top5 Avg. | | | 7.9 | 28.4 | 14.6 | 27.2 | 43.0 | 87% | 61% |
| 1674-10 | McMBOAT | 1191-4-11 | 3.1 | 39.0 | 18.1 | 18.7 | 57.1 | 90% | 75% |
| 1674-2 | McMBOAT | 1191-4-11 | 3.3 | 37.8 | 17.7 | 19.4 | 55.5 | 89% | 74% |
| 1674-11 | McMBOAT | 1191-4-11 | 3.2 | 37.7 | 17.0 | 19.0 | 54.8 | 87% | 74% |
| 1674-14 | McMBOAT | 1191-4-11 | 4.2 | 34.9 | 17.5 | 21.6 | 52.4 | 89% | 71% |
| 1674-13 | McMBOAT | 1191-4-11 | 3.3 | 34.5 | 17.6 | 21.1 | 52.1 | 87% | 71% |
| 1674-9 | McMBOAT | 1191-4-11 | 3.0 | 36.8 | 14.3 | 20.8 | 51.2 | 85% | 71% |
| 1674-5 | McMBOAT | 1191-4-11 | 4.7 | 34.9 | 15.9 | 21.3 | 50.8 | 87% | 70% |
| 1674-7 | McMBOAT | 1191-4-11 | 4.3 | 33.8 | 16.8 | 21.7 | 50.6 | 87% | 70% |
| 1674-6 | McMBOAT | 1191-4-11 | 5.2 | 32.2 | 17.1 | 25.5 | 49.3 | 91% | 66% |
| 1674-4 | McMBOAT | 1191-4-11 | 5.4 | 30.7 | 14.9 | 25.8 | 45.6 | 86% | 64% |
| 1674-1 | McMBOAT | 1191-4-11 | 4.6 | 29.2 | 15.6 | 25.2 | 44.8 | 85% | 64% |
| 1674-12 | McMBOAT | 1191-4-11 | 6.1 | 30.8 | 13.6 | 27.3 | 44.4 | 89% | 62% |
| 1674-15 | McMBOAT | 1191-4-11 | 4.9 | 28.4 | 14.5 | 24.9 | 42.9 | 83% | 63% |
| 1674-3 | McMBOAT | 1191-4-11 | 11.1 | 20.5 | 12.7 | 32.9 | 33.2 | 85% | 50% |
| 1674-8 | McMBOAT | 1191-4-11 | 11.5 | 16.8 | 8.4 | 36.4 | 25.3 | 82% | 41% |
| Top5 Avg. | | | 3.4 | 36.8 | 17.6 | 20.0 | 54.4 | 88% | 73% |

TABLE 67

Fatty acid profile of T2 seed from events expressing MBOATs in
DGLA/ETA-expressing transgenic event 1022-4-9 (EgD9Elo/TpomD8Des)
T2 seed for pKR1022 (EgD9Elo/TpomD8Des) background event transformed with various MBOATs

| Event # | MBOAT | Bkgrnd | % Oil | 16:0 | 18:0 | 18:1 | 18:2 | GLA | 18:3 | STA | 20:0 | 20:1 | EDA |
|---|---|---|---|---|---|---|---|---|---|---|---|---|---|
| | | 1022-4-9 | | 7.6 | 3.0 | 16.6 | 26.2 | 0.0 | 11.1 | 0.0 | 1.2 | 14.4 | 8.9 |
| HD1-18 | Vect Cont | 1022-4-9 | | 7.7 | 2.4 | 12.8 | 20.6 | 0.0 | 15.5 | 0.0 | 1.3 | 11.8 | 10.9 |
| HD1-3 | Vect Cont | 1022-4-9 | | 6.6 | 2.6 | 15.1 | 21.7 | 0.2 | 11.7 | 0.0 | 1.3 | 14.0 | 11.7 |
| HD1-8 | Vect Cont | 1022-4-9 | | 7.6 | 2.7 | 15.4 | 20.0 | 0.2 | 13.2 | 0.0 | 1.4 | 11.8 | 11.8 |
| HD1-2 | Vect Cont | 1022-4-9 | | 7.3 | 2.5 | 13.5 | 19.6 | 0.1 | 16.0 | 0.0 | 1.3 | 12.3 | 11.0 |
| HD1-5 | Vect Cont | 1022-4-9 | | 6.9 | 2.5 | 18.6 | 19.0 | 0.1 | 12.6 | 0.0 | 1.3 | 11.4 | 12.0 |
| HD1-1 | Vect Cont | 1022-4-9 | | 6.6 | 2.4 | 17.0 | 18.4 | 0.1 | 15.0 | 0.0 | 1.2 | 11.8 | 11.4 |

TABLE 67-continued

Fatty acid profile of T2 seed from events expressing MBOATs in
DGLA/ETA-expressing transgenic event 1022-4-9 (EgD9Elo/TpomD8Des)
T2 seed for pKR1022 (EgD9Elo/TpomD8Des) background event transformed with various MBOATs

| | | | | | | | | | | | |
|---|---|---|---|---|---|---|---|---|---|---|---|
| HD1-7 | Vect Cont | 1022-4-9 | 6.1 | 2.6 | 16.5 | 18.9 | 0.1 | 14.3 | 0.0 | 1.5 | 13.5 | 11.1 |
| HD1-9 | Vect Cont | 1022-4-9 | 6.5 | 2.6 | 16.3 | 19.2 | 0.2 | 13.7 | 0.0 | 1.5 | 13.2 | 11.6 |
| HD1-14 | Vect Cont | 1022-4-9 | 7.3 | 2.7 | 14.2 | 20.2 | 0.1 | 13.3 | 0.0 | 1.6 | 12.8 | 12.3 |
| HD1-12 | Vect Cont | 1022-4-9 | 7.0 | 2.6 | 13.3 | 19.4 | 0.0 | 15.3 | 0.0 | 1.5 | 13.1 | 11.7 |
| HD1-10 | Vect Cont | 1022-4-9 | 7.3 | 2.6 | 13.5 | 20.8 | 0.0 | 15.2 | 0.0 | 1.5 | 13.0 | 11.1 |
| HD1-16 | Vect Cont | 1022-4-9 | 6.9 | 2.6 | 13.0 | 20.7 | 0.1 | 14.5 | 0.0 | 1.6 | 13.8 | 11.7 |
| HD1-17 | Vect Cont | 1022-4-9 | 6.4 | 2.6 | 15.8 | 19.6 | 0.2 | 13.9 | 0.0 | 1.5 | 13.4 | 11.8 |
| HD1-4 | Vect Cont | 1022-4-9 | 7.0 | 2.7 | 14.9 | 20.1 | 0.0 | 13.8 | 0.0 | 1.5 | 12.8 | 12.4 |
| HD1-15 | Vect Cont | 1022-4-9 | 7.3 | 3.4 | 14.6 | 23.4 | 0.1 | 12.0 | 0.0 | 1.6 | 15.9 | 9.9 |
| HD1-6 | Vect Cont | 1022-4-9 | 6.9 | 2.9 | 15.4 | 23.9 | 0.1 | 12.2 | 0.0 | 1.4 | 15.6 | 10.0 |
| HD1-11 | Vect Cont | 1022-4-9 | 6.7 | 3.3 | 14.9 | 24.1 | 0.1 | 11.7 | 0.0 | 1.6 | 15.7 | 10.4 |
| HD1-13 | Vect Cont | 1022-4-9 | 7.1 | 3.4 | 14.9 | 24.9 | 0.1 | 12.0 | 0.0 | 1.7 | 16.5 | 9.4 |
| Top5 Avg. | | | 7.2 | 2.5 | 15.1 | 20.2 | 0.1 | 13.8 | 0.0 | 1.4 | 12.2 | 11.5 |
| 1671-12 | GmMBOAT1 | 1022-4-9 | 7.5 | 2.7 | 18.2 | 12.6 | 0.2 | 4.3 | 0.0 | 1.2 | 4.5 | 17.5 |
| 1671-9 | GmMBOAT1 | 1022-4-9 | 7.1 | 2.6 | 11.1 | 13.5 | 0.2 | 6.4 | 0.0 | 1.4 | 5.9 | 19.6 |
| 1671-6 | GmMBOAT1 | 1022-4-9 | 7.1 | 2.5 | 14.6 | 13.0 | 0.2 | 5.6 | 0.0 | 1.3 | 5.5 | 18.3 |
| 1671-3 | GmMBOAT1 | 1022-4-9 | 7.1 | 2.8 | 14.4 | 14.0 | 0.3 | 6.1 | 0.0 | 1.3 | 6.2 | 18.6 |
| 1671-7 | GmMBOAT1 | 1022-4-9 | 7.6 | 3.1 | 14.9 | 15.0 | 0.0 | 5.5 | 0.0 | 1.3 | 6.6 | 17.8 |
| 1671-11 | GmMBOAT1 | 1022-4-9 | 7.2 | 2.5 | 11.2 | 15.1 | 0.0 | 6.9 | 0.0 | 1.4 | 6.0 | 19.7 |
| 1671-13 | GmMBOAT1 | 1022-4-9 | 7.0 | 2.6 | 10.7 | 14.8 | 0.0 | 7.0 | 0.0 | 1.5 | 6.4 | 19.9 |
| 1671-1 | GmMBOAT1 | 1022-4-9 | 6.9 | 2.5 | 11.9 | 15.0 | 0.1 | 7.5 | 0.0 | 1.4 | 7.1 | 18.6 |
| 1671-5 | GmMBOAT1 | 1022-4-9 | 7.6 | 2.6 | 11.6 | 16.4 | 0.0 | 7.4 | 0.0 | 1.4 | 7.0 | 18.2 |
| 1671-8 | GmMBOAT1 | 1022-4-9 | 6.8 | 2.5 | 12.9 | 15.5 | 0.2 | 8.0 | 0.0 | 1.3 | 7.1 | 17.8 |
| 1671-4 | GmMBOAT1 | 1022-4-9 | 6.5 | 2.5 | 13.9 | 16.5 | 0.2 | 7.8 | 0.0 | 1.4 | 8.1 | 17.8 |
| 1671-14 | GmMBOAT1 | 1022-4-9 | 6.5 | 2.8 | 14.4 | 16.6 | 0.1 | 7.0 | 0.0 | 1.3 | 7.8 | 18.9 |
| 1671-10 | GmMBOAT1 | 1022-4-9 | 6.6 | 2.3 | 17.0 | 19.1 | 0.1 | 14.2 | 0.0 | 1.3 | 12.0 | 11.9 |
| 1671-2 | GmMBOAT1 | 1022-4-9 | 7.9 | 3.3 | 15.9 | 26.7 | 0.0 | 11.7 | 0.0 | 1.5 | 15.7 | 8.9 |
| Top5 Avg. | | | 7.3 | 2.7 | 14.6 | 13.6 | 0.2 | 5.6 | 0.0 | 1.3 | 5.8 | 18.4 |
| 1672-14 | GmMBOAT2 | 1022-4-9 | 7.2 | 2.5 | 13.8 | 9.4 | 0.2 | 3.5 | 0.0 | 1.2 | 4.0 | 19.4 |
| 1672-12 | GmMBOAT2 | 1022-4-9 | 6.8 | 2.7 | 12.7 | 12.1 | 0.2 | 4.9 | 0.0 | 1.4 | 4.9 | 20.1 |
| 1672-15 | GmMBOAT2 | 1022-4-9 | 7.5 | 2.5 | 12.1 | 14.7 | 0.0 | 6.8 | 0.0 | 1.5 | 6.0 | 17.8 |
| 1672-10 | GmMBOAT2 | 1022-4-9 | 6.3 | 2.4 | 14.7 | 12.6 | 0.1 | 6.2 | 0.0 | 1.4 | 6.2 | 18.9 |
| 1672-8 | GmMBOAT2 | 1022-4-9 | 7.6 | 2.7 | 15.7 | 14.7 | 0.4 | 6.6 | 0.0 | 1.4 | 7.4 | 15.6 |
| 1672-3 | GmMBOAT2 | 1022-4-9 | 6.9 | 2.5 | 11.6 | 14.3 | 0.1 | 6.8 | 0.0 | 1.5 | 6.8 | 19.5 |
| 1672-16 | GmMBOAT2 | 1022-4-9 | 6.1 | 2.6 | 12.9 | 14.1 | 0.2 | 7.1 | 0.0 | 1.5 | 7.1 | 18.8 |
| 1672-2 | GmMBOAT2 | 1022-4-9 | 6.8 | 2.5 | 14.3 | 15.2 | 0.2 | 6.5 | 0.0 | 1.5 | 6.9 | 17.9 |
| 1672-5 | GmMBOAT2 | 1022-4-9 | 6.9 | 2.8 | 16.1 | 14.8 | 0.2 | 5.7 | 0.0 | 1.4 | 7.0 | 18.1 |
| 1672-9 | GmMBOAT2 | 1022-4-9 | 6.7 | 2.5 | 11.1 | 15.2 | 0.0 | 8.7 | 0.0 | 1.5 | 7.3 | 18.0 |
| 1672-13 | GmMBOAT2 | 1022-4-9 | 7.8 | 2.5 | 11.8 | 16.1 | 0.0 | 7.6 | 0.0 | 1.5 | 6.3 | 18.4 |
| 1672-4 | GmMBOAT2 | 1022-4-9 | 6.6 | 2.4 | 13.6 | 15.6 | 0.2 | 7.8 | 0.0 | 1.5 | 7.2 | 17.7 |
| 1672-17 | GmMBOAT2 | 1022-4-9 | 7.4 | 2.6 | 11.4 | 16.8 | 0.2 | 8.3 | 0.0 | 1.6 | 7.7 | 17.0 |
| 1672-7 | GmMBOAT2 | 1022-4-9 | 7.3 | 2.5 | 11.4 | 16.8 | 0.1 | 8.3 | 0.0 | 1.5 | 7.1 | 17.8 |
| 1672-6 | GmMBOAT2 | 1022-4-9 | 6.3 | 2.5 | 14.5 | 15.1 | 0.2 | 7.8 | 0.0 | 1.5 | 7.8 | 17.8 |
| 1672-11 | GmMBOAT2 | 1022-4-9 | 7.0 | 2.6 | 10.6 | 17.3 | 0.0 | 8.9 | 0.0 | 1.5 | 7.7 | 17.8 |
| 1672-1 | GmMBOAT2 | 1022-4-9 | 6.6 | 2.8 | 14.1 | 21.5 | 0.2 | 13.8 | 0.0 | 1.5 | 14.6 | 10.3 |
| Top5 Avg. | | | 7.1 | 2.6 | 13.8 | 12.7 | 0.2 | 5.6 | 0.0 | 1.4 | 5.7 | 18.4 |
| 1673-10 | CoMBOAT | 1022-4-9 | 7.4 | 2.5 | 11.2 | 14.1 | 0.0 | 8.2 | 0.0 | 1.5 | 7.0 | 17.3 |
| 1673-14 | CoMBOAT | 1022-4-9 | 7.4 | 2.6 | 12.6 | 16.3 | 0.0 | 9.0 | 0.0 | 1.6 | 8.1 | 17.0 |
| 1673-11 | CoMBOAT | 1022-4-9 | 6.8 | 2.4 | 15.3 | 15.5 | 0.2 | 9.1 | 0.0 | 1.3 | 7.1 | 16.2 |
| 1673-6 | CoMBOAT | 1022-4-9 | 6.9 | 2.2 | 12.9 | 15.5 | 0.0 | 9.2 | 0.0 | 1.4 | 7.9 | 18.0 |
| 1673-2 | CoMBOAT | 1022-4-9 | 7.3 | 2.5 | 12.8 | 16.8 | 0.0 | 9.8 | 0.0 | 1.6 | 8.6 | 16.3 |
| 1673-13 | CoMBOAT | 1022-4-9 | 7.5 | 2.6 | 15.3 | 17.6 | 0.0 | 9.2 | 0.0 | 1.4 | 8.1 | 15.9 |
| 1673-9 | CoMBOAT | 1022-4-9 | 6.5 | 2.5 | 15.4 | 16.1 | 0.1 | 9.1 | 0.0 | 1.6 | 8.5 | 17.0 |
| 1673-5 | CoMBOAT | 1022-4-9 | 6.7 | 2.5 | 15.5 | 16.7 | 0.0 | 9.6 | 0.0 | 1.4 | 8.2 | 16.3 |
| 1673-1 | CoMBOAT | 1022-4-9 | 6.4 | 2.3 | 12.2 | 20.5 | 0.1 | 9.1 | 0.0 | 1.4 | 9.6 | 17.1 |
| 1673-15 | CoMBOAT | 1022-4-9 | 6.3 | 2.4 | 13.2 | 17.5 | 0.0 | 11.3 | 0.0 | 1.5 | 9.4 | 15.3 |
| 1673-3 | CoMBOAT | 1022-4-9 | 6.2 | 2.4 | 13.0 | 18.0 | 0.1 | 11.0 | 0.0 | 1.6 | 10.2 | 15.6 |
| 1673-8 | CoMBOAT | 1022-4-9 | 6.8 | 2.4 | 10.6 | 19.0 | 0.0 | 12.7 | 0.0 | 1.5 | 9.9 | 15.0 |
| 1673-7 | CoMBOAT | 1022-4-9 | 6.8 | 2.5 | 15.2 | 18.4 | 0.1 | 10.3 | 0.0 | 1.5 | 9.4 | 15.7 |
| 1673-4 | CoMBOAT | 1022-4-9 | 7.0 | 2.4 | 11.7 | 19.7 | 0.0 | 12.0 | 0.0 | 1.5 | 10.3 | 15.1 |
| 1673-16 | CoMBOAT | 1022-4-9 | 6.8 | 2.4 | 11.2 | 20.4 | 0.0 | 12.8 | 0.0 | 1.4 | 10.4 | 15.0 |
| 1673-12 | CoMBOAT | 1022-4-9 | 7.5 | 2.9 | 13.3 | 21.2 | 0.0 | 10.4 | 0.0 | 1.4 | 10.7 | 14.9 |
| Top5 Avg. | | | 7.2 | 2.4 | 13.0 | 15.7 | 0.0 | 9.1 | 0.0 | 1.5 | 7.7 | 16.9 |
| 1674-16 | McMBOAT | 1022-4-9 | 7.1 | 2.5 | 10.8 | 12.3 | 0.0 | 5.9 | 0.0 | 1.4 | 4.2 | 20.8 |
| 1674-11 | McMBOAT | 1022-4-9 | 7.6 | 2.4 | 17.4 | 14.1 | 0.2 | 6.1 | 0.0 | 1.2 | 5.4 | 18.0 |
| 1674-4 | McMBOAT | 1022-4-9 | 7.1 | 2.5 | 10.0 | 15.1 | 0.0 | 8.5 | 0.0 | 1.6 | 6.1 | 18.8 |
| 1674-17 | McMBOAT | 1022-4-9 | 6.9 | 2.4 | 13.9 | 14.4 | 0.1 | 7.3 | 0.0 | 1.4 | 5.1 | 19.1 |
| 1674-12 | McMBOAT | 1022-4-9 | 6.5 | 2.5 | 11.1 | 13.9 | 0.0 | 7.7 | 0.0 | 1.7 | 6.4 | 20.2 |
| 1674-13 | McMBOAT | 1022-4-9 | 6.5 | 2.5 | 16.2 | 13.5 | 0.2 | 6.4 | 0.0 | 1.6 | 6.1 | 19.1 |
| 1674-18 | McMBOAT | 1022-4-9 | 6.5 | 2.4 | 10.8 | 15.4 | 0.0 | 8.8 | 0.0 | 1.6 | 6.6 | 18.9 |
| 1674-6 | McMBOAT | 1022-4-9 | 7.0 | 2.3 | 10.1 | 16.9 | 0.0 | 9.7 | 0.0 | 1.5 | 7.0 | 17.8 |
| 1674-8 | MCMBOAT | 1022-4-9 | 7.2 | 2.6 | 10.5 | 17.0 | 0.2 | 9.0 | 0.0 | 1.8 | 7.9 | 16.7 |

TABLE 67-continued

Fatty acid profile of T2 seed from events expressing MBOATs in DGLA/ETA-expressing transgenic event 1022-4-9 (EgD9Elo/TpomD8Des)
T2 seed for pKR1022 (EgD9Elo/TpomD8Des) background event transformed with various MBOATs

| | | | | | | | | | | | | | |
|---|---|---|---|---|---|---|---|---|---|---|---|---|---|
| 1674-7 | McMBOAT | 1022-4-9 | | 6.0 | 2.7 | 12.3 | 16.8 | 0.2 | 8.5 | 0.0 | 1.6 | 9.2 | 17.5 |
| 1674-1 | McMBOAT | 1022-4-9 | | 6.3 | 2.3 | 11.5 | 16.7 | 0.0 | 9.5 | 0.0 | 1.5 | 7.1 | 18.3 |
| 1674-5 | McMBOAT | 1022-4-9 | | 6.4 | 2.5 | 14.9 | 16.2 | 0.1 | 8.1 | 0.0 | 1.6 | 7.7 | 17.9 |
| 1674-2 | MCMBOAT | 1022-4-9 | | 7.0 | 3.0 | 13.7 | 17.4 | 0.0 | 6.7 | 0.0 | 1.4 | 6.0 | 21.9 |
| 1674-9 | McMBOAT | 1022-4-9 | | 7.0 | 3.3 | 12.3 | 18.6 | 0.0 | 6.9 | 0.0 | 1.7 | 7.0 | 21.3 |
| 1674-15 | McMBOAT | 1022-4-9 | | 6.8 | 2.7 | 12.5 | 20.6 | 0.1 | 9.9 | 0.0 | 1.4 | 9.7 | 16.7 |
| 1674-14 | McMBOAT | 1022-4-9 | | 8.4 | 2.8 | 16.0 | 19.1 | 0.0 | 10.6 | 0.0 | 1.4 | 9.7 | 14.1 |
| 1674-3 | McMBOAT | 1022-4-9 | | 6.6 | 2.9 | 14.1 | 20.9 | 0.1 | 11.0 | 0.0 | 1.4 | 11.9 | 14.1 |
| 1674-10 | McMBOAT | 1022-4-9 | | 6.6 | 2.7 | 14.4 | 21.0 | 0.0 | 14.0 | 0.0 | 1.6 | 13.9 | 12.3 |
| Top5 Avg. | | | | 7.0 | 2.5 | 12.6 | 14.0 | 0.1 | 7.1 | 0.0 | 1.5 | 5.4 | 19.4 |
| 1845-12 | EuphMBOAT | 1022-4-9-2 | 24.3 | 6.6 | 3.0 | 18.5 | 16.5 | 0.0 | 7.5 | 0.0 | 1.8 | 10.6 | 13.3 |
| 1845-7 | EuphMBOAT | 1022-4-9-2 | 27.7 | 6.6 | 2.8 | 16.0 | 17.9 | 0.0 | 7.6 | 0.0 | 1.5 | 10.8 | 16.6 |
| 1845-16 | EuphMBOAT | 1022-4-9-2 | 23.8 | 7.3 | 3.5 | 18.4 | 18.1 | 0.0 | 6.8 | 0.0 | 1.8 | 11.5 | 13.3 |
| 1845-8 | EuphMBOAT | 1022-4-9-2 | 28.8 | 6.9 | 3.1 | 17.6 | 18.7 | 0.0 | 7.8 | 0.0 | 1.6 | 11.7 | 13.8 |
| 1845-4 | EuphMBOAT | 1022-4-9-2 | 31.5 | 6.3 | 2.9 | 16.1 | 17.6 | 0.0 | 8.9 | 0.0 | 1.7 | 11.0 | 16.0 |
| 1845-2 | EuphMBOAT | 1022-4-9-2 | 27.2 | 6.4 | 3.1 | 17.0 | 18.0 | 0.0 | 8.6 | 0.0 | 1.8 | 12.4 | 13.8 |
| 1845-11 | EuphMBOAT | 1022-4-9-2 | 30.3 | 7.1 | 3.0 | 16.2 | 19.4 | 0.0 | 9.7 | 0.0 | 1.6 | 12.3 | 13.4 |
| 1845-15 | EuphMBOAT | 1022-4-9-2 | 31.8 | 6.3 | 2.7 | 13.7 | 18.0 | 0.0 | 12.4 | 0.0 | 1.7 | 12.3 | 14.1 |
| 1845-1 | EuphMBOAT | 1022-4-9-2 | 29.1 | 7.0 | 3.0 | 16.6 | 18.6 | 0.0 | 10.4 | 0.0 | 1.6 | 11.8 | 13.5 |
| 1845-5 | EuphMBOAT | 1022-4-9-2 | 30.3 | 7.2 | 3.0 | 17.3 | 19.3 | 0.0 | 10.1 | 0.0 | 1.5 | 11.4 | 13.3 |
| 1845-6 | EuphMBOAT | 1022-4-9-2 | 31.4 | 6.4 | 2.7 | 15.3 | 19.5 | 0.0 | 11.8 | 0.0 | 1.7 | 12.2 | 13.4 |
| 1845-3 | EuphMBOAT | 1022.4-9-2 | 33.2 | 6.4 | 2.7 | 15.8 | 18.1 | 0.0 | 12.9 | 0.0 | 1.6 | 12.9 | 13.2 |
| 1845-17 | EuphMBOAT | 1022-4-9-2 | 34.6 | 6.0 | 2.8 | 15.9 | 19.6 | 0.0 | 11.4 | 0.0 | 1.6 | 13.7 | 13.6 |
| 1845-10 | EuphMBOAT | 1022-4-9-2 | 33.6 | 6.6 | 3.0 | 15.5 | 21.3 | 0.0 | 11.5 | 0.0 | 1.7 | 14.0 | 11.8 |
| 1845-9 | EuphMBOAT | 1022-4-9-2 | 41.7 | 7.8 | 3.4 | 15.5 | 21.0 | 0.0 | 10.1 | 0.0 | 1.5 | 11.4 | 14.6 |
| 1845-13 | EuphMBOAT | 1022-4-9-2 | 35.3 | 7.1 | 2.9 | 16.1 | 21.3 | 0.0 | 11.5 | 0.0 | 1.5 | 13.2 | 12.3 |
| 1845-14 | EuphMBOAT | 1022-4-9-2 | 34.3 | 6.4 | 2.8 | 15.2 | 22.0 | 0.0 | 13.6 | 0.0 | 1.7 | 14.8 | 10.2 |
| Top5 Avg. | | | 27.2 | 6.7 | 3.1 | 17.3 | 17.8 | 0.0 | 7.7 | 0.0 | 1.7 | 11.1 | 14.6 |

| Event # | MBOAT | Bkgrnd | DGLA | ERA | ETA | LA + ALA | EDA + ERA | DGLA + ETA | % D12Des | % D9Elo |
|---|---|---|---|---|---|---|---|---|---|---|
| | | 1022-4-9 | 5.2 | 4.4 | 1.2 | 37.3 | 13.3 | 6.3 | 77% | 35% |
| HD1-18 | Vect Cont | 1022-4-9 | 7.0 | 7.8 | 2.2 | 36.1 | 18.7 | 9.2 | 83% | 44% |
| HD1-3 | Vect Cont | 1022-4-9 | 6.9 | 6.5 | 1.8 | 33.4 | 18.2 | 8.7 | 80% | 45% |
| HD1-8 | Vect Cont | 1022-4-9 | 6.5 | 7.3 | 2.1 | 33.2 | 19.2 | 8.6 | 80% | 46% |
| HD1-2 | Vect Cont | 1022-4-9 | 6.0 | 8.1 | 2.2 | 35.6 | 19.1 | 8.2 | 82% | 43% |
| HD1-5 | Vect Cont | 1022-4-9 | 6.2 | 7.5 | 1.9 | 31.6 | 19.4 | 8.1 | 76% | 47% |
| HD1-1 | Vect Cont | 1022-4-9 | 5.8 | 8.2 | 2.0 | 33.4 | 19.6 | 7.9 | 78% | 45% |
| HD1-7 | Vect Cont | 1022-4-9 | 5.9 | 7.6 | 2.0 | 33.2 | 18.7 | 7.8 | 78% | 44% |
| HD1-9 | Vect Cont | 1022-4-9 | 5.9 | 7.5 | 1.9 | 33.0 | 19.0 | 7.8 | 79% | 45% |
| HD1-14 | Vect Cont | 1022-4-9 | 5.9 | 7.5 | 1.8 | 33.6 | 19.8 | 7.7 | 81% | 45% |
| HD1-12 | Vect Cont | 1022-4-9 | 5.7 | 8.3 | 2.0 | 34.7 | 20.1 | 7.6 | 82% | 44% |
| HD1-10 | Vect Cont | 1022-4-9 | 5.6 | 7.6 | 1.8 | 35.9 | 18.7 | 7.4 | 82% | 42% |
| HD1-16 | Vect Cont | 1022-4-9 | 5.6 | 7.6 | 1.8 | 35.2 | 19.3 | 7.4 | 83% | 43% |
| HD1-17 | Vect Cont | 1022-4-9 | 5.4 | 7.6 | 1.7 | 33.5 | 19.4 | 7.1 | 79% | 44% |
| HD1-4 | Vect Cont | 1022-4-9 | 5.4 | 7.7 | 1.7 | 33.9 | 20.2 | 7.0 | 80% | 45% |
| HD1-15 | Vect Cont | 1022-4-9 | 4.9 | 5.6 | 1.2 | 35.4 | 15.5 | 6.2 | 80% | 38% |
| HD1-6 | Vect Cont | 1022-4-9 | 4.8 | 5.6 | 1.2 | 36.1 | 15.5 | 6.1 | 79% | 37% |
| HD1-11 | Vect Cont | 1022-4-9 | 4.8 | 5.6 | 1.2 | 35.8 | 16.0 | 5.9 | 80% | 38% |
| HD1-13 | Vect Cont | 1022-4-9 | 4.1 | 5.1 | 1.0 | 36.9 | 14.4 | 5.1 | 79% | 35% |
| Top5 Avg. | | | 6.5 | 7.4 | 2.0 | 34.0 | 18.9 | 8.6 | 80% | 45% |
| 1671-12 | GmMBOAT1 | 1022-4-9 | 20.0 | 5.6 | 5.8 | 16.9 | 23.1 | 25.7 | 78% | 74% |
| 1671-9 | GmMBOAT1 | 1022-4-9 | 18.8 | 7.8 | 5.8 | 19.8 | 27.4 | 24.6 | 87% | 72% |
| 1671-6 | GmMBOAT1 | 1022-4-9 | 18.4 | 7.4 | 6.1 | 18.6 | 25.7 | 24.5 | 82% | 73% |
| 1671-3 | GmMBOAT1 | 1022-4-9 | 17.5 | 6.8 | 4.9 | 20.1 | 25.4 | 22.4 | 83% | 70% |
| 1671-7 | GmMBOAT1 | 1022-4-9 | 18.0 | 5.8 | 4.3 | 20.5 | 23.7 | 22.3 | 82% | 69% |
| 1671-11 | GmMBOAT1 | 1022-4-9 | 16.7 | 8.1 | 5.2 | 21.9 | 27.8 | 21.9 | 86% | 69% |
| 1671-13 | GmMBOAT1 | 1022-4-9 | 16.2 | 8.8 | 5.3 | 21.8 | 28.6 | 21.5 | 87% | 70% |
| 1671-1 | GmMBOAT1 | 1022-4-9 | 15.5 | 8.3 | 5.3 | 22.5 | 26.9 | 20.8 | 85% | 68% |
| 1671-5 | GmMBOAT1 | 1022-4-9 | 15.1 | 7.9 | 4.8 | 23.7 | 26.1 | 20.0 | 86% | 66% |
| 1671-8 | GmMBOAT1 | 1022-4-9 | 14.8 | 8.2 | 4.9 | 23.5 | 26.0 | 19.8 | 84% | 66% |
| 1671-4 | GmMBOAT1 | 1022-4-9 | 13.3 | 7.8 | 4.2 | 24.3 | 25.6 | 17.5 | 83% | 64% |
| 1671-14 | GmMBOAT1 | 1022-4-9 | 13.7 | 7.1 | 3.7 | 23.6 | 26.0 | 17.4 | 82% | 65% |
| 1671-10 | GmMBOAT1 | 1022-4-9 | 6.0 | 7.7 | 1.9 | 33.3 | 19.6 | 7.9 | 78% | 45% |
| 1671-2 | GmMBOAT1 | 1022-4-9 | 3.4 | 4.3 | 0.7 | 38.4 | 13.2 | 4.2 | 78% | 31% |
| Top5 Avg. | | | 18.5 | 6.7 | 5.4 | 19.2 | 25.0 | 23.9 | 82% | 72% |
| 1672-14 | GmMBOAT2 | 1022-4-9 | 24.7 | 6.2 | 7.7 | 12.9 | 25.7 | 32.4 | 84% | 82% |
| 1672-12 | GmMBOAT2 | 1022-4-9 | 20.7 | 7.3 | 6.2 | 17.0 | 27.4 | 26.9 | 85% | 76% |
| 1672-15 | GmMBOAT2 | 1022-4-9 | 16.3 | 8.4 | 6.4 | 21.5 | 26.2 | 22.7 | 85% | 69% |
| 1672-10 | GmMBOAT2 | 1022-4-9 | 16.1 | 8.7 | 6.4 | 18.8 | 27.6 | 22.5 | 82% | 73% |
| 1672-8 | GmMBOAT2 | 1022-4-9 | 16.2 | 6.3 | 5.3 | 21.3 | 21.9 | 21.5 | 80% | 67% |

TABLE 67-continued

Fatty acid profile of T2 seed from events expressing MBOATs in
DGLA/ETA-expressing transgenic event 1022-4-9 (EgD9Elo/TpomD8Des)
T2 seed for pKR1022 (EgD9Elo/TpomD8Des) background event transformed with various MBOATs

| | | | | | | | | | |
|---|---|---|---|---|---|---|---|---|---|
| 1672-3 | GmMBOAT2 | 1022-4-9 | 16.1 | 8.6 | 5.3 | 21.0 | 28.1 | 21.4 | 86% | 70% |
| 1672-16 | GmMBOAT2 | 1022-4-9 | 16.0 | 8.6 | 5.2 | 21.1 | 27.4 | 21.2 | 84% | 70% |
| 1672-2 | GmMBOAT2 | 1022-4-9 | 15.4 | 7.5 | 5.3 | 21.7 | 25.5 | 20.7 | 83% | 68% |
| 1672-5 | GmMBOAT2 | 1022-4-9 | 16.0 | 6.6 | 4.4 | 20.6 | 24.7 | 20.4 | 80% | 69% |
| 1672-9 | GmMBOAT2 | 1022-4-9 | 14.3 | 9.4 | 5.2 | 23.9 | 27.4 | 19.5 | 86% | 66% |
| 1672-13 | GmMBOAT2 | 1022-4-9 | 14.0 | 8.8 | 5.2 | 23.7 | 27.2 | 19.2 | 86% | 66% |
| 1672-4 | GmMBOAT2 | 1022-4-9 | 14.1 | 8.6 | 4.8 | 23.3 | 26.3 | 18.9 | 83% | 66% |
| 1672-17 | GmMBOAT2 | 1022-4-9 | 13.8 | 8.4 | 4.9 | 25.1 | 25.4 | 18.7 | 86% | 64% |
| 1672-7 | GmMBOAT2 | 1022-4-9 | 13.4 | 8.9 | 4.7 | 25.2 | 26.7 | 18.2 | 86% | 64% |
| 1672-6 | GmMBOAT2 | 1022-4-9 | 13.3 | 8.5 | 4.6 | 23.0 | 26.3 | 18.0 | 82% | 66% |
| 1672-11 | GmMBOAT2 | 1022-4-9 | 13.4 | 8.8 | 4.5 | 26.2 | 26.6 | 17.9 | 87% | 63% |
| 1672-1 | GmMBOAT2 | 1022-4-9 | 6.1 | 6.6 | 1.9 | 35.3 | 16.9 | 8.0 | 81% | 41% |
| Top5 Avg. | | | 18.8 | 7.4 | 6.4 | 18.3 | 25.8 | 25.2 | 83% | 73% |
| 1673-10 | CoMBOAT | 1022-4-9 | 15.9 | 8.7 | 6.2 | 22.3 | 25.9 | 22.1 | 86% | 68% |
| 1673-14 | CoMBOAT | 1022-4-9 | 12.8 | 8.2 | 4.5 | 25.3 | 25.1 | 17.3 | 84% | 63% |
| 1673-11 | CoMBOAT | 1022-4-9 | 12.5 | 8.9 | 4.8 | 24.6 | 25.1 | 17.2 | 81% | 63% |
| 1673-6 | CoMBOAT | 1022-4-9 | 12.1 | 9.5 | 4.5 | 24.8 | 27.5 | 16.5 | 84% | 64% |
| 1673-2 | CoMBOAT | 1022-4-9 | 11.5 | 8.6 | 4.2 | 26.6 | 24.9 | 15.7 | 84% | 60% |
| 1673-13 | CoMBOAT | 1022-4-9 | 10.9 | 7.7 | 3.7 | 26.8 | 23.7 | 14.6 | 81% | 59% |
| 1673-9 | CoMBOAT | 1022-4-9 | 10.7 | 8.8 | 3.7 | 25.1 | 25.8 | 14.5 | 81% | 62% |
| 1673-5 | CoMBOAT | 1022-4-9 | 10.4 | 8.9 | 3.8 | 26.3 | 25.3 | 14.2 | 81% | 60% |
| 1673-1 | CoMBOAT | 1022-4-9 | 11.4 | 7.2 | 2.6 | 29.6 | 24.3 | 14.0 | 85% | 56% |
| 1673-15 | CoMBOAT | 1022-4-9 | 9.8 | 9.6 | 3.7 | 28.8 | 24.8 | 13.6 | 84% | 57% |
| 1673-3 | CoMBOAT | 1022-4-9 | 9.5 | 9.1 | 3.2 | 29.0 | 24.7 | 12.7 | 84% | 56% |
| 1673-8 | CoMBOAT | 1022-4-9 | 9.0 | 9.8 | 3.2 | 31.6 | 24.9 | 12.3 | 87% | 54% |
| 1673-7 | CoMBOAT | 1022-4-9 | 8.4 | 8.6 | 2.9 | 28.7 | 24.3 | 11.3 | 81% | 55% |
| 1673-4 | CoMBOAT | 1022-4-9 | 8.6 | 8.8 | 2.8 | 31.7 | 23.9 | 11.3 | 85% | 53% |
| 1673-16 | CoMBOAT | 1022-4-9 | 8.2 | 8.9 | 2.7 | 33.1 | 23.9 | 10.8 | 86% | 51% |
| 1673-12 | CoMBOAT | 1022-4-9 | 8.0 | 7.4 | 2.4 | 31.6 | 22.3 | 10.4 | 83% | 51% |
| Top5 Avg. | | | 13.0 | 8.8 | 4.8 | 24.7 | 25.7 | 17.8 | 84% | 64% |
| 1674-16 | McMBOAT | 1022-4-9 | 18.3 | 10.4 | 6.4 | 18.2 | 31.1 | 24.7 | 87% | 75% |
| 1674-11 | McMBOAT | 1022-4-9 | 14.7 | 7.9 | 5.0 | 20.3 | 26.0 | 19.6 | 79% | 69% |
| 1674-4 | McMBOAT | 1022-4-9 | 14.4 | 10.9 | 5.2 | 23.5 | 29.7 | 19.6 | 88% | 68% |
| 1674-17 | McMBOAT | 1022-4-9 | 14.5 | 10.1 | 4.9 | 21.7 | 29.2 | 19.4 | 83% | 69% |
| 1674-12 | McMBOAT | 1022-4-9 | 14.1 | 10.9 | 5.0 | 21.6 | 31.1 | 19.0 | 87% | 70% |
| 1674-13 | McMBOAT | 1022-4-9 | 13.8 | 9.3 | 4.8 | 19.9 | 28.3 | 18.6 | 81% | 70% |
| 1674-18 | McMBOAT | 1022-4-9 | 13.9 | 10.5 | 4.5 | 24.2 | 29.4 | 18.4 | 87% | 66% |
| 1674-6 | McMBOAT | 1022-4-9 | 13.0 | 10.3 | 4.4 | 26.6 | 28.1 | 17.4 | 88% | 63% |
| 1674-8 | MCMBOAT | 1022-4-9 | 12.4 | 9.8 | 5.0 | 26.0 | 26.5 | 17.4 | 87% | 63% |
| 1674-7 | McMBOAT | 1022-4-9 | 12.8 | 8.7 | 3.8 | 25.3 | 26.2 | 16.6 | 85% | 63% |
| 1674-1 | McMBOAT | 1022-4-9 | 12.2 | 10.6 | 4.0 | 26.2 | 28.9 | 16.2 | 86% | 63% |
| 1674-5 | McMBOAT | 1022-4-9 | 11.8 | 9.0 | 3.6 | 24.4 | 27.0 | 15.5 | 82% | 64% |
| 1674-2 | MCMBOAT | 1022-4-9 | 12.1 | 8.0 | 2.6 | 24.1 | 29.9 | 14.8 | 83% | 65% |
| 1674-9 | McMBOAT | 1022-4-9 | 11.5 | 7.9 | 2.5 | 25.6 | 29.2 | 14.0 | 85% | 63% |
| 1674-15 | McMBOAT | 1022-4-9 | 9.3 | 8.1 | 2.3 | 30.5 | 24.8 | 11.6 | 84% | 54% |
| 1674-14 | McMBOAT | 1022-4-9 | 8.2 | 7.4 | 2.3 | 29.7 | 21.5 | 10.5 | 79% | 52% |
| 1674-3 | McMBOAT | 1022-4-9 | 8.4 | 6.5 | 2.0 | 31.9 | 20.6 | 10.4 | 82% | 49% |
| 1674-10 | McMBOAT | 1022-4-9 | 4.6 | 7.6 | 1.4 | 35.0 | 19.9 | 6.0 | 81% | 43% |
| Top5 Avg. | | | 15.2 | 10.0 | 5.3 | 21.1 | 29.4 | 20.5 | 85% | 70% |
| 1845-12 | EuphMBOAT | 1022-4-9-2 | 10.9 | 7.1 | 4.2 | 24.0 | 20.4 | 15.1 | 76% | 60% |
| 1845-7 | EuphMBOAT | 1022-4-9-2 | 10.7 | 6.9 | 2.5 | 25.6 | 23.5 | 13.2 | 80% | 59% |
| 1845-16 | EuphMBOAT | 1022-4-9-2 | 10.2 | 6.0 | 3.0 | 24.9 | 19.3 | 13.2 | 76% | 57% |
| 1845-8 | EuphMBOAT | 1022-4-9-2 | 9.6 | 6.3 | 2.9 | 26.5 | 20.2 | 12.5 | 77% | 55% |
| 1845-4 | EuphMBOAT | 1022-4-9-2 | 9.3 | 7.3 | 2.8 | 26.5 | 23.3 | 12.2 | 79% | 57% |
| 1845-2 | EuphMBOAT | 1022-4-9-2 | 9.1 | 6.8 | 3.0 | 26.6 | 20.6 | 12.1 | 78% | 55% |
| 1845-11 | EuphMBOAT | 1022-4-9-2 | 8.3 | 6.7 | 2.3 | 29.1 | 20.1 | 10.6 | 79% | 51% |
| 1845-15 | EuphMBOAT | 1022-4-9-2 | 7.8 | 8.4 | 2.7 | 30.3 | 22.5 | 10.5 | 82% | 52% |
| 1845-1 | EuphMBOAT | 1022-4-9-2 | 8.0 | 7.1 | 2.4 | 29.0 | 20.6 | 10.4 | 78% | 52% |
| 1845-5 | EuphMBOAT | 1022-4-9-2 | 7.9 | 6.7 | 2.2 | 29.4 | 20.0 | 10.1 | 77% | 51% |
| 1845-6 | EuphMBOAT | 1022-4-9-2 | 7.1 | 7.4 | 2.6 | 31.2 | 20.8 | 9.7 | 80% | 49% |
| 1845-3 | EuphMBOAT | 1022-4.9-2 | 6.5 | 7.7 | 2.2 | 31.0 | 20.9 | 8.8 | 79% | 49% |
| 1845-17 | EuphMBOAT | 1022-4-9-2 | 6.6 | 7.0 | 1.8 | 31.0 | 20.6 | 8.4 | 79% | 48% |
| 1845-10 | EuphMBOAT | 1022-4-9-2 | 6.3 | 6.3 | 2.1 | 32.8 | 18.1 | 8.3 | 79% | 45% |
| 1845-9 | EuphMBOAT | 1022-4-9-2 | 6.7 | 6.4 | 1.5 | 31.1 | 21.0 | 8.2 | 80% | 48% |
| 1845-13 | EuphMBOAT | 1022-4-9-2 | 6.1 | 6.3 | 1.7 | 32.8 | 18.6 | 7.8 | 79% | 45% |
| 1845-14 | EuphMBOAT | 1022-4-9-2 | 5.2 | 6.0 | 2.0 | 35.5 | 16.2 | 7.3 | 80% | 40% |
| Top5 Avg. | | | 10.1 | 6.7 | 3.1 | 25.5 | 21.3 | 13.2 | 78% | 58% |

TABLE 68

Fatty acid profile of T2 seed from events expressing MBOATs in
DGLA/ETA-expressing transgenic event 1192-1-2 (EaD9Elo/EaD8Des)
T2 seed for 1192 (EaD9Elo/EaD8Des) background event transformed with various MBOATs

| Event # | MBOAT | Bkgrnd | % Oil | 16:0 | 18:0 | 18:1 | 18:2 | GLA | 18:3 | STA | 20:0 | 20:1 | EDA | DGLA |
|---|---|---|---|---|---|---|---|---|---|---|---|---|---|---|
| 1192-1-2 | | | | 8.4 | 3.5 | 14.7 | 23.5 | 0.0 | 10.7 | 0.0 | 1.4 | 13.5 | 11.2 | 5.4 |
| HD1-4 | Vect Cont | 1192-1-2 | 37.6 | 12.6 | 3.2 | 24.8 | 11.7 | 0.5 | 6.0 | 0.0 | 1.6 | 7.7 | 9.4 | 9.9 |
| HD1-7 | Vect Cont | 1192-1-2 | 35.0 | 11.2 | 3.5 | 19.9 | 16.9 | 0.0 | 11.0 | 0.0 | 1.3 | 8.0 | 7.5 | 8.9 |
| HD1-13 | Vect Cont | 1192-1-2 | 32.3 | 8.8 | 3.0 | 17.4 | 16.7 | 0.5 | 11.1 | 0.0 | 1.3 | 9.7 | 9.9 | 8.6 |
| HD1-9 | Vect Cont | 1192-1-2 | 9.6 | 8.6 | 3.0 | 20.2 | 15.4 | 0.6 | 10.5 | 0.0 | 1.3 | 8.8 | 10.6 | 8.0 |
| HD1-6 | Vect Cont | 1192-1-2 | 33.8 | 10.9 | 2.8 | 19.2 | 17.0 | 0.2 | 8.1 | 0.0 | 1.3 | 9.2 | 10.6 | 8.3 |
| HD1-10 | Vect Cont | 1192-1-2 | 23.6 | 10.1 | 2.7 | 18.2 | 17.5 | 0.0 | 11.1 | 0.0 | 1.4 | 8.6 | 10.2 | 8.3 |
| HD1-5 | Vect Cont | 1192-1-2 | 28.5 | 8.7 | 3.3 | 16.3 | 19.0 | 0.5 | 10.1 | 0.0 | 1.3 | 10.8 | 10.8 | 8.3 |
| HD1-11 | Vect Cont | 1192-1-2 | 31.9 | 9.4 | 3.3 | 16.5 | 18.0 | 0.5 | 12.1 | 0.0 | 1.2 | 10.2 | 9.2 | 7.7 |
| HD1-3 | Vect Cont | 1192-1-2 | 27.4 | 9.5 | 3.6 | 17.3 | 19.3 | 0.6 | 9.0 | 0.0 | 1.3 | 9.9 | 11.0 | 7.9 |
| HD1-12 | Vect Cont | 1192-1-2 | 22.9 | 10.4 | 2.5 | 23.9 | 15.8 | 0.0 | 12.4 | 0.0 | 1.2 | 7.8 | 8.4 | 6.4 |
| HD1-2 | Vect Cont | 1192-1-2 | 33.2 | 9.6 | 3.1 | 16.2 | 20.1 | 0.2 | 9.4 | 0.0 | 1.3 | 10.2 | 12.2 | 7.0 |
| HD1-8 | Vect Cont | 1192-1-2 | 28.6 | 9.3 | 2.9 | 16.9 | 20.7 | 0.2 | 9.0 | 0.0 | 1.3 | 10.2 | 12.4 | 6.9 |
| HD1-1 | Vect Cont | 1192-1-2 | 29.7 | 9.1 | 3.5 | 15.4 | 21.1 | 0.3 | 10.2 | 0.0 | 1.2 | 12.0 | 11.3 | 6.3 |
| Top5 Avg. | | | 29.7 | 10.4 | 3.1 | 20.3 | 15.6 | 0.4 | 9.3 | 0.0 | 1.4 | 8.7 | 9.6 | 8.7 |
| 1671-1 | GmMBOAT1 | 1192-1-2 | 23.1 | 7.5 | 3.1 | 16.9 | 8.3 | 0.0 | 2.7 | 0.0 | 1.7 | 4.7 | 18.3 | 22.0 |
| 1671-4 | GmMBOAT1 | 1192-1-2 | 24.9 | 7.4 | 3.3 | 18.0 | 10.3 | 0.0 | 3.5 | 0.0 | 1.5 | 6.2 | 18.6 | 19.4 |
| 1671-11 | GmMBOAT1 | 1192-1-2 | 29.8 | 7.4 | 3.4 | 17.2 | 10.0 | 0.0 | 3.7 | 0.0 | 1.7 | 6.3 | 18.7 | 18.1 |
| 1671-9 | GmMBOAT1 | 1192-1-2 | 28.7 | 7.2 | 3.5 | 19.8 | 9.1 | 0.0 | 3.0 | 0.0 | 1.7 | 6.2 | 18.6 | 18.2 |
| 1671-7 | GmMBOAT1 | 1192-1-2 | 28.4 | 7.2 | 3.3 | 17.8 | 10.2 | 0.0 | 3.7 | 0.0 | 1.7 | 6.5 | 18.5 | 18.0 |
| 1671-6 | GmMBOAT1 | 1192-1-2 | 28.0 | 8.0 | 3.3 | 17.4 | 10.4 | 0.0 | 3.6 | 0.0 | 1.5 | 6.1 | 19.4 | 18.6 |
| 1671-15 | GmMBOAT1 | 1192-1-2 | 30.4 | 8.2 | 3.8 | 17.8 | 10.0 | 0.0 | 3.4 | 0.0 | 1.6 | 6.2 | 18.9 | 18.6 |
| 1671-3 | GmMBOAT1 | 1192-1-2 | 25.2 | 7.7 | 3.7 | 20.2 | 9.7 | 0.0 | 3.1 | 0.0 | 1.8 | 6.9 | 17.9 | 17.4 |
| 1671-12 | GmMBOAT1 | 1192-1-2 | 29.6 | 7.9 | 3.5 | 18.6 | 10.2 | 0.0 | 3.9 | 0.0 | 1.5 | 6.4 | 18.5 | 17.0 |
| 1671-2 | GmMBOAT1 | 1192-1-2 | 29.1 | 7.9 | 3.4 | 18.8 | 11.2 | 0.0 | 4.6 | 0.0 | 1.5 | 6.5 | 18.3 | 15.5 |
| 1671-8 | GmMBOAT1 | 1192-1-2 | 26.5 | 8.3 | 3.7 | 21.6 | 10.8 | 0.0 | 3.8 | 0.0 | 1.5 | 6.9 | 17.1 | 16.2 |
| 1671-14 | GmMBOAT1 | 1192-1-2 | 29.1 | 8.1 | 3.8 | 20.1 | 9.7 | 0.0 | 3.6 | 0.0 | 1.6 | 6.8 | 18.8 | 15.8 |
| 1671-16 | GmMBOAT1 | 1192-1-2 | 30.8 | 8.4 | 3.6 | 20.6 | 10.9 | 0.0 | 3.8 | 0.0 | 1.3 | 6.3 | 18.4 | 16.0 |
| 1671-10 | GmMBOAT1 | 1192-1-2 | 30.4 | 8.1 | 3.6 | 18.4 | 11.6 | 0.0 | 4.4 | 0.0 | 1.4 | 6.3 | 18.8 | 15.1 |
| 1671-5 | GmMBOAT1 | 1192-1-2 | 27.6 | 7.4 | 3.8 | 20.5 | 10.4 | 0.0 | 3.5 | 0.0 | 1.8 | 7.1 | 18.6 | 15.0 |
| 1671-13 | GmMBOAT1 | 1192-1-2 | 28.0 | 7.4 | 3.5 | 20.7 | 16.4 | 0.5 | 7.3 | 0.0 | 1.7 | 12.3 | 13.0 | 7.3 |
| Top5 Avg. | | | 27.0 | 7.4 | 3.3 | 18.0 | 9.6 | 0.0 | 3.3 | 0.0 | 1.7 | 6.0 | 18.5 | 19.1 |
| 1672-3 | GmMBOAT2 | 1192-1-2 | 30.6 | 8.3 | 3.7 | 17.8 | 10.6 | 0.0 | 2.9 | 0.0 | 1.6 | 5.3 | 21.1 | 17.2 |
| 1672-4 | GmMBOAT2 | 1192-1-2 | 28.5 | 7.5 | 3.3 | 21.0 | 9.3 | 0.0 | 3.3 | 0.0 | 1.4 | 6.1 | 19.6 | 16.2 |
| 1672-9 | GmMBOAT2 | 1192-1-2 | 23.7 | 8.1 | 3.4 | 20.7 | 10.1 | 0.0 | 3.5 | 0.0 | 1.7 | 6.8 | 17.5 | 15.7 |
| 1672-7 | GmMBOAT2 | 1192-1-2 | 24.9 | 8.3 | 3.3 | 21.9 | 9.1 | 0.0 | 2.4 | 0.0 | 1.5 | 6.6 | 19.0 | 15.9 |
| 1672-8 | GmMBOAT2 | 1192-1-2 | 31.2 | 7.6 | 3.5 | 20.7 | 10.6 | 0.2 | 3.5 | 0.0 | 1.3 | 7.2 | 19.7 | 15.6 |
| 1672-5 | GmMBOAT2 | 1192-1-2 | 27.1 | 7.4 | 3.5 | 19.1 | 12.2 | 0.0 | 3.9 | 0.0 | 1.8 | 7.2 | 19.0 | 14.0 |
| 1672-2 | GmMBOAT2 | 1192-1-2 | 26.5 | 7.9 | 3.5 | 21.7 | 11.1 | 0.0 | 4.0 | 0.0 | 1.4 | 7.5 | 18.2 | 13.9 |
| 1672-1 | GmMBOAT2 | 1192-1-2 | 26.1 | 7.2 | 3.9 | 24.3 | 10.0 | 0.0 | 3.3 | 0.0 | 1.8 | 8.5 | 16.9 | 12.9 |
| 1672-6 | GmMBOAT2 | 1192-1-2 | 28.3 | 7.6 | 3.7 | 21.4 | 10.9 | 0.0 | 4.2 | 0.0 | 1.5 | 8.1 | 18.2 | 12.9 |
| Top5 Avg. | | | 27.8 | 8.0 | 3.4 | 20.4 | 9.9 | 0.0 | 3.1 | 0.0 | 1.5 | 6.4 | 19.4 | 16.1 |
| 1673-5 | CoMBOAT | 1192-1-2 | 39.0 | 8.9 | 3.1 | 16.9 | 12.6 | 0.3 | 5.4 | 0.0 | 1.0 | 6.7 | 16.4 | 14.7 |
| 1673-4 | CoMBOAT | 1192-1-2 | 29.1 | 9.7 | 2.7 | 20.0 | 12.1 | 0.0 | 5.4 | 0.0 | 1.3 | 5.8 | 14.4 | 13.7 |
| 1673-6 | CoMBOAT | 1192-1-2 | 29.3 | 9.5 | 2.6 | 18.9 | 12.7 | 0.0 | 4.4 | 0.0 | 1.2 | 5.7 | 17.9 | 14.9 |
| 1673-7 | CoMBOAT | 1192-1-2 | 24.9 | 9.3 | 3.3 | 19.5 | 13.1 | 0.6 | 6.7 | 0.0 | 1.3 | 7.4 | 11.9 | 13.2 |
| 1673-11 | CoMBOAT | 1192-1-2 | 31.4 | 8.6 | 3.3 | 19.6 | 12.1 | 0.6 | 6.3 | 0.0 | 1.3 | 7.4 | 13.9 | 12.7 |
| 1673-8 | CoMBOAT | 1192-1-2 | 25.5 | 10.4 | 3.1 | 19.7 | 11.1 | 0.0 | 4.6 | 0.0 | 1.5 | 6.0 | 17.4 | 13.6 |
| 1673-12 | CoMBOAT | 1192-1-2 | 31.3 | 9.9 | 2.5 | 17.8 | 14.6 | 0.0 | 6.9 | 0.0 | 1.3 | 6.3 | 13.6 | 12.4 |
| 1673-2 | CoMBOAT | 1192-1-2 | 20.9 | 9.5 | 3.0 | 18.4 | 12.1 | 0.0 | 7.4 | 0.0 | 1.3 | 6.5 | 14.6 | 11.9 |
| 1673-10 | CoMBOAT | 1192-1-2 | 23.9 | 10.9 | 2.9 | 18.9 | 14.6 | 0.0 | 7.6 | 0.0 | 1.1 | 6.2 | 12.7 | 11.7 |
| 1673-1 | CoMBOAT | 1192-1-2 | 29.8 | 8.5 | 3.5 | 16.5 | 15.5 | 0.0 | 6.2 | 0.0 | 1.3 | 7.7 | 16.7 | 12.5 |
| 1673-3 | CoMBOAT | 1192-1-2 | 23.9 | 9.1 | 3.4 | 18.2 | 14.4 | 0.6 | 7.0 | 0.0 | 1.3 | 8.6 | 12.4 | 11.5 |
| 1673-9 | CoMBOAT | 1192-1-2 | 15.7 | 8.4 | 3.0 | 17.6 | 14.2 | 0.5 | 6.6 | 0.0 | 1.1 | 9.5 | 14.1 | 11.2 |
| Top5 Avg. | | | 30.7 | 9.2 | 3.0 | 19.0 | 12.5 | 0.3 | 5.7 | 0.0 | 1.2 | 6.6 | 14.9 | 13.8 |
| 1674-1 | McMBOAT | 1192-1-2 | 35.2 | 8.8 | 3.4 | 15.0 | 12.3 | 0.3 | 4.2 | 0.0 | 1.2 | 3.8 | 20.0 | 17.5 |
| 1674-4 | McMBOAT | 1192-1-2 | 27.9 | 9.4 | 2.8 | 18.9 | 9.7 | 0.0 | 3.8 | 0.0 | 1.4 | 4.4 | 18.9 | 16.5 |
| 1674-2 | McMBOAT | 1192-1-2 | 27.6 | 10.0 | 2.9 | 17.9 | 11.8 | 0.0 | 5.6 | 0.0 | 1.5 | 5.3 | 14.8 | 15.3 |
| 1674-3 | McMBOAT | 1192-1-2 | 24.0 | 8.8 | 3.1 | 18.6 | 12.4 | 0.4 | 5.0 | 0.0 | 1.2 | 5.1 | 16.0 | 15.3 |
| 1674-5 | McMBOAT | 1192-1-2 | 26.8 | 9.0 | 3.0 | 18.0 | 12.1 | 0.3 | 5.0 | 0.3 | 1.2 | 6.6 | 16.4 | 14.7 |
| 1674-7 | McMBOAT | 1192-1-2 | 27.9 | 8.5 | 2.8 | 19.5 | 10.7 | 0.2 | 5.2 | 0.3 | 1.1 | 7.0 | 15.3 | 13.9 |
| 1674-8 | McMBOAT | 1192-1-2 | 37.5 | 9.3 | 2.6 | 19.1 | 11.7 | 0.5 | 5.3 | 0.0 | 1.0 | 9.0 | 15.1 | 14.3 |
| 1674-6 | McMBOAT | 1192-1-2 | 25.0 | 8.5 | 2.4 | 17.2 | 13.1 | 0.0 | 6.4 | 0.0 | 1.1 | 8.3 | 15.7 | 13.8 |
| Top5 Avg. | | | 28.3 | 9.2 | 3.0 | 17.7 | 11.6 | 0.2 | 4.7 | 0.1 | 1.3 | 5.0 | 17.2 | 15.8 |
| 1845-12 | EuphMBOAT | 1192-1-2 | 22.6 | 8.8 | 3.4 | 21.9 | 12.5 | 0.0 | 5.3 | 0.0 | 1.6 | 11.2 | 13.7 | 9.2 |
| 1845-6 | EuphMBOAT | 1192-1-2 | 25.9 | 7.7 | 3.5 | 20.9 | 14.6 | 0.0 | 6.6 | 0.0 | 1.7 | 10.7 | 14.6 | 8.4 |
| 1845-13 | EuphMBOAT | 1192-1-2 | 27.5 | 8.5 | 3.5 | 18.8 | 14.7 | 0.3 | 6.5 | 0.0 | 1.5 | 10.7 | 15.6 | 8.7 |
| 1845-11 | EuphMBOAT | 1192-1-2 | 25.3 | 7.9 | 3.6 | 20.2 | 14.1 | 0.3 | 6.0 | 0.0 | 1.6 | 11.5 | 15.4 | 8.5 |
| 1845-8 | EuphMBOAT | 1192-1-2 | 26.3 | 8.0 | 3.6 | 22.3 | 14.2 | 0.4 | 5.4 | 0.0 | 1.6 | 11.3 | 14.8 | 8.4 |

TABLE 68-continued

Fatty acid profile of T2 seed from events expressing MBOATs in
DGLA/ETA-expressing transgenic event 1192-1-2 (EaD9Elo/EaD8Des)
T2 seed for 1192 (EaD9Elo/EaD8Des) background event transformed with various MBOATs

| | | | | | | | | | | | | | | |
|---|---|---|---|---|---|---|---|---|---|---|---|---|---|---|
| 1845-2 | EuphMBOAT | 1192-1-2 | 27.8 | 7.9 | 3.6 | 21.2 | 14.7 | 0.0 | 6.7 | 0.0 | 1.7 | 11.6 | 13.8 | 8.0 |
| 1845-10 | EuphMBOAT | 1192-1-2 | 25.2 | 7.9 | 3.8 | 21.6 | 14.4 | 0.0 | 6.1 | 0.0 | 1.8 | 11.6 | 14.2 | 8.1 |
| 1845-7 | EuphMBOAT | 1192-1-2 | 26.7 | 7.8 | 3.4 | 18.1 | 15.5 | 0.4 | 7.0 | 0.0 | 1.6 | 11.1 | 15.7 | 8.3 |
| 1845-4 | EuphMBOAT | 1192-1-2 | 24.6 | 7.7 | 3.7 | 22.9 | 13.3 | 0.5 | 6.1 | 0.0 | 1.7 | 11.1 | 14.0 | 8.0 |
| 1845.9 | EuphMBOAT | 1192-1-2 | 23.9 | 8.3 | 3.9 | 22.0 | 14.2 | 0.5 | 5.3 | 0.0 | 1.5 | 12.0 | 14.7 | 8.4 |
| 1845-15 | EuphMBOAT | 1192-1-2 | 24.4 | 8.5 | 3.7 | 21.9 | 14.9 | 0.4 | 5.6 | 0.0 | 1.4 | 10.4 | 15.4 | 8.4 |
| 1845-5 | EuphMBOAT | 1192-1-2 | 25.6 | 8.7 | 3.6 | 19.0 | 15.8 | 0.3 | 6.6 | 0.0 | 1.6 | 10.3 | 15.7 | 8.2 |
| 1845-3 | EuphMBOAT | 1192-1-2 | 25.7 | 7.7 | 3.6 | 22.3 | 14.2 | 0.3 | 5.9 | 0.0 | 1.5 | 11.5 | 15.0 | 8.1 |
| 1845-14 | EuphMBOAT | 1192-1-2 | 28.5 | 8.0 | 3.7 | 20.6 | 15.6 | 0.0 | 7.2 | 0.0 | 1.7 | 11.5 | 13.8 | 7.6 |
| 1845-1 | EuphMBOAT | 1192-1-2 | 27.1 | 8.4 | 3.4 | 21.0 | 15.1 | 0.3 | 7.8 | 0.0 | 1.4 | 10.7 | 13.7 | 7.5 |
| 1845-16 | EuphMBOAT | 1192-1-2 | 28.2 | 8.2 | 3.3 | 18.8 | 16.7 | 0.5 | 8.4 | 0.0 | 1.6 | 13.3 | 12.1 | 6.6 |
| Top5 Avg. | | | 25.5 | 8.2 | 3.5 | 20.8 | 14.0 | 0.2 | 6.0 | 0.0 | 1.6 | 11.1 | 14.9 | 8.6 |

| Event # | MBOAT | Bkgrnd | ERA | ETA | LA + ALA | EDA + ERA | DGLA + ETA | % D12Des | % D9Elo | % D8Des |
|---|---|---|---|---|---|---|---|---|---|---|
| 1192-1-2 | | | 6.0 | 1.7 | 34.2 | 17.2 | 7.2 | 80% | 42% | 29% |
| HD1-4 | Vect Cont | 1192-1-2 | 5.6 | 3.7 | 17.8 | 15.0 | 13.7 | 65% | 62% | 48% |
| HD1-7 | Vect Cont | 1192-1-2 | 5.9 | 4.1 | 27.9 | 13.4 | 13.0 | 73% | 49% | 49% |
| HD1-13 | Vect Cont | 1192-1-2 | 7.4 | 4.0 | 27.8 | 17.2 | 12.6 | 77% | 52% | 42% |
| HD1-9 | Vect Cont | 1192-1-2 | 7.4 | 3.8 | 25.9 | 18.0 | 11.8 | 73% | 54% | 40% |
| HD1-6 | Vect Cont | 1192-1-2 | 6.5 | 3.4 | 25.1 | 17.1 | 11.7 | 74% | 53% | 41% |
| HD1-10 | Vect Cont | 1192-1-2 | 6.9 | 3.4 | 28.6 | 17.1 | 11.6 | 76% | 50% | 40% |
| HD1-5 | Vect Cont | 1192-1-2 | 6.6 | 3.1 | 29.1 | 17.3 | 11.4 | 78% | 50% | 40% |
| HD1-11 | Vect Cont | 1192-1-2 | 6.9 | 3.5 | 30.1 | 16.2 | 11.3 | 78% | 48% | 41% |
| HD1-3 | Vect Cont | 1192-1-2 | 6.4 | 3.1 | 28.2 | 17.4 | 11.0 | 77% | 50% | 39% |
| HD1-12 | Vect Cont | 1192-1-2 | 6.3 | 3.1 | 28.2 | 14.8 | 9.6 | 69% | 46% | 39% |
| HD1-2 | Vect Cont | 1192-1-2 | 6.9 | 2.4 | 29.6 | 19.1 | 9.4 | 78% | 49% | 33% |
| HD1-8 | Vect Cont | 1192-1-2 | 6.5 | 2.3 | 29.6 | 18.9 | 9.2 | 77% | 49% | 33% |
| HD1-1 | Vect Cont | 1192-1-2 | 6.4 | 2.2 | 31.3 | 17.6 | 8.6 | 79% | 45% | 33% |
| Top5 Avg. | | | 6.6 | 3.8 | 24.9 | 16.2 | 12.6 | 72% | 54% | 44% |
| 1671-1 | GmMBOAT1 | 1192-1-2 | 6.0 | 8.6 | 11.0 | 24.4 | 30.6 | 80% | 83% | 56% |
| 1671-4 | GmMBOAT1 | 1192-1-2 | 5.5 | 6.3 | 13.8 | 24.1 | 25.7 | 78% | 78% | 52% |
| 1671-11 | GmMBOAT1 | 1192-1-2 | 6.6 | 6.9 | 13.7 | 25.3 | 25.0 | 79% | 79% | 50% |
| 1671-9 | GmMBOAT1 | 1192-1-2 | 5.9 | 6.7 | 12.1 | 24.5 | 24.9 | 76% | 80% | 50% |
| 1671-7 | GmMBOAT1 | 1192-1-2 | 6.3 | 6.7 | 13.9 | 24.8 | 24.7 | 78% | 78% | 50% |
| 1671-6 | GmMBOAT1 | 1192-1-2 | 5.9 | 5.7 | 14.0 | 25.3 | 24.4 | 78% | 78% | 49% |
| 1671-15 | GmMBOAT1 | 1192-1-2 | 5.9 | 5.7 | 13.3 | 24.8 | 24.3 | 78% | 79% | 50% |
| 1671-3 | GmMBOAT1 | 1192-1-2 | 5.7 | 5.9 | 12.8 | 23.6 | 23.3 | 75% | 79% | 50% |
| 1671-12 | GmMBOAT1 | 1192-1-2 | 6.4 | 6.1 | 14.1 | 24.8 | 23.2 | 77% | 77% | 48% |
| 1671-2 | GmMBOAT1 | 1192-1-2 | 6.6 | 5.8 | 15.8 | 24.8 | 21.3 | 77% | 75% | 46% |
| 1671-8 | GmMBOAT1 | 1192-1-2 | 5.1 | 5.0 | 14.7 | 22.2 | 21.1 | 73% | 75% | 49% |
| 1671-14 | GmMBOAT1 | 1192-1-2 | 6.4 | 5.3 | 13.4 | 25.2 | 21.1 | 75% | 78% | 45% |
| 1671-16 | GmMBOAT1 | 1192-1-2 | 5.8 | 5.0 | 14.6 | 24.2 | 21.0 | 74% | 76% | 47% |
| 1671-10 | GmMBOAT1 | 1192-1-2 | 6.7 | 5.5 | 16.0 | 25.5 | 20.7 | 77% | 74% | 45% |
| 1671-5 | GmMBOAT1 | 1192-1-2 | 6.4 | 5.5 | 13.8 | 25.0 | 20.5 | 74% | 77% | 45% |
| 1671-13 | GmMBOAT1 | 1192-1-2 | 6.8 | 3.1 | 23.7 | 19.8 | 10.4 | 72% | 56% | 34% |
| Top5 Avg. | | | 6.1 | 7.0 | 12.9 | 24.6 | 26.2 | 78% | 80% | 51% |
| 1672-3 | GmMBOAT2 | 1192-1-2 | 6.2 | 5.3 | 13.6 | 27.3 | 22.6 | 78% | 79% | 45% |
| 1672-4 | GmMBOAT2 | 1192-1-2 | 6.4 | 6.0 | 12.6 | 26.0 | 22.2 | 74% | 79% | 46% |
| 1672-9 | GmMBOAT2 | 1192-1-2 | 6.4 | 6.2 | 13.5 | 23.9 | 21.9 | 74% | 77% | 48% |
| 1672-7 | GmMBOAT2 | 1192-1-2 | 6.1 | 5.8 | 11.5 | 25.1 | 21.7 | 73% | 80% | 46% |
| 1672-8 | GmMBOAT2 | 1192-1-2 | 5.6 | 4.4 | 14.1 | 25.3 | 20.0 | 74% | 76% | 44% |
| 1672-5 | GmMBOAT2 | 1192-1-2 | 6.8 | 5.1 | 16.1 | 25.8 | 19.2 | 76% | 74% | 43% |
| 1672-2 | GmMBOAT2 | 1192-1-2 | 6.2 | 4.7 | 15.1 | 24.4 | 18.6 | 73% | 74% | 43% |
| 1672-1 | GmMBOAT2 | 1192-1-2 | 6.2 | 5.1 | 13.3 | 23.1 | 18.0 | 69% | 76% | 44% |
| 1672-6 | GmMBOAT2 | 1192-1-2 | 7.0 | 4.6 | 15.0 | 25.2 | 17.4 | 73% | 74% | 41% |
| Top5 Avg. | | | 6.1 | 5.5 | 13.1 | 25.5 | 21.7 | 75% | 78% | 46% |
| 1673-5 | CoMBOAT | 1192-1-2 | 6.9 | 5.6 | 17.9 | 23.3 | 20.3 | 78% | 71% | 47% |
| 1673-4 | CoMBOAT | 1192-1-2 | 7.1 | 6.0 | 17.5 | 21.5 | 19.7 | 75% | 70% | 48% |
| 1673-6 | CoMBOAT | 1192-1-2 | 6.0 | 4.6 | 17.1 | 23.9 | 19.5 | 76% | 72% | 45% |
| 1673-7 | CoMBOAT | 1192-1-2 | 6.4 | 5.7 | 19.8 | 18.3 | 19.0 | 75% | 65% | 51% |
| 1673-11 | CoMBOAT | 1192-1-2 | 7.2 | 5.7 | 18.4 | 21.0 | 18.5 | 75% | 68% | 47% |
| 1673-8 | CoMBOAT | 1192-1-2 | 6.5 | 4.8 | 15.7 | 24.0 | 18.4 | 75% | 73% | 43% |
| 1673-12 | CoMBOAT | 1192-1-2 | 7.3 | 5.5 | 21.6 | 20.9 | 17.9 | 77% | 64% | 46% |
| 1673-2 | CoMBOAT | 1192-1-2 | 8.2 | 5.8 | 19.5 | 22.8 | 17.7 | 77% | 67% | 44% |
| 1673-10 | CoMBOAT | 1192-1-2 | 6.9 | 5.0 | 22.2 | 19.6 | 16.7 | 76% | 62% | 46% |
| 1673-1 | CoMBOAT | 1192-1-2 | 6.4 | 4.0 | 21.8 | 23.1 | 16.5 | 79% | 65% | 42% |
| 1673-3 | CoMBOAT | 1192-1-2 | 6.8 | 5.0 | 21.4 | 19.2 | 16.5 | 76% | 62% | 46% |
| 1673-9 | CoMBOAT | 1192-1-2 | 7.3 | 4.6 | 20.9 | 21.4 | 15.7 | 77% | 64% | 42% |
| Top5 Avg. | | | 6.7 | 5.5 | 18.1 | 21.6 | 19.4 | 76% | 69% | 47% |

TABLE 68-continued

Fatty acid profile of T2 seed from events expressing MBOATs in
DGLA/ETA-expressing transgenic event 1192-1-2 (EaD9Elo/EaD8Des)
T2 seed for 1192 (EaD9Elo/EaD8Des) background event transformed with various MBOATs

| | | | | | | | | | |
|---|---|---|---|---|---|---|---|---|---|
| 1674-1 | McMBOAT | 1192-1-2 | 7.4 | 5.3 | 16.5 | 27.5 | 22.7 | 82% | 75% | 45% |
| 1674-4 | McMBOAT | 1192-1-2 | 7.1 | 6.1 | 13.5 | 25.9 | 22.6 | 77% | 78% | 47% |
| 1674-2 | McMBOAT | 1192-1-2 | 7.6 | 6.2 | 17.4 | 22.4 | 21.5 | 77% | 72% | 49% |
| 1674-3 | McMBOAT | 1192-1-2 | 7.2 | 5.7 | 17.4 | 23.2 | 21.0 | 77% | 72% | 47% |
| 1674-5 | McMBOAT | 1192-1-2 | 7.6 | 5.8 | 17.1 | 23.9 | 20.6 | 77% | 72% | 46% |
| 1674-7 | McMBOAT | 1192-1-2 | 8.9 | 6.4 | 15.9 | 24.2 | 20.3 | 76% | 74% | 46% |
| 1674-8 | McMBOAT | 1192-1-2 | 7.0 | 5.2 | 17.1 | 22.1 | 19.5 | 75% | 71% | 47% |
| 1674-6 | McMBOAT | 1192-1-2 | 7.9 | 5.6 | 19.5 | 23.6 | 19.4 | 78% | 69% | 45% |
| Top5 Avg. | | | 7.4 | 5.8 | 16.4 | 24.6 | 21.7 | 78% | 74% | 47% |
| 1845-12 | EuphMBOAT | 1192-1-2 | 8.0 | 4.4 | 17.8 | 21.8 | 13.5 | 71% | 66% | 38% |
| 1845-6 | EuphMBOAT | 1192-1-2 | 7.6 | 3.5 | 21.2 | 22.4 | 11.9 | 73% | 62% | 35% |
| 1845-13 | EuphMBOAT | 1192-1-2 | 7.8 | 3.2 | 21.2 | 23.4 | 11.9 | 75% | 62% | 34% |
| 1845-11 | EuphMBOAT | 1192-1-2 | 7.5 | 3.1 | 20.2 | 22.9 | 11.6 | 73% | 63% | 34% |
| 1845-8 | EuphMBOAT | 1192-1-2 | 6.8 | 3.2 | 19.5 | 21.7 | 11.6 | 70% | 63% | 35% |
| 1845-2 | EuphMBOAT | 1192-1-2 | 7.3 | 3.5 | 21.3 | 21.1 | 11.5 | 72% | 60% | 35% |
| 1845-10 | EuphMBOAT | 1192-1-2 | 7.2 | 3.4 | 20.5 | 21.4 | 11.5 | 71% | 62% | 35% |
| 1845-7 | EuphMBOAT | 1192-1-2 | 8.0 | 3.1 | 22.6 | 23.6 | 11.4 | 76% | 61% | 33% |
| 1845-4 | EuphMBOAT | 1192-1-2 | 7.4 | 3.4 | 19.4 | 21.5 | 11.4 | 70% | 63% | 35% |
| 1845.9 | EuphMBOAT | 1192-1-2 | 6.4 | 2.9 | 19.4 | 21.1 | 11.3 | 70% | 63% | 35% |
| 1845-15 | EuphMBOAT | 1192-1-2 | 6.6 | 2.8 | 20.5 | 21.9 | 11.2 | 71% | 62% | 34% |
| 1845-5 | EuphMBOAT | 1192-1-2 | 7.4 | 3.0 | 22.3 | 23.0 | 11.2 | 75% | 61% | 33% |
| 1845-3 | EuphMBOAT | 1192-1-2 | 7.0 | 2.9 | 20.1 | 22.1 | 11.0 | 70% | 62% | 33% |
| 1845-14 | EuphMBOAT | 1192-1-2 | 7.3 | 3.2 | 22.7 | 21.1 | 10.8 | 73% | 58% | 34% |
| 1845-1 | EuphMBOAT | 1192-1-2 | 7.5 | 3.1 | 22.9 | 21.2 | 10.6 | 72% | 58% | 33% |
| 1845-16 | EuphMBOAT | 1192-1-2 | 7.6 | 3.1 | 25.1 | 19.7 | 9.7 | 74% | 54% | 33% |
| Top5 Avg. | | | 7.5 | 3.5 | 20.0 | 22.4 | 12.1 | 72% | 63% | 35% |

TABLE 69

Fatty acid profile of T2 seed from events expressing MBOATs in
DGLA/ETA-expressing transgenic event 1203-13-1-5 (EgD9Elo-EaD8Des fusion)
T2 seed for 1203 (EgD9Elo-EaD8Des fusion) background event transformed with various MBOATs

| Event # | MBOAT | Bkgrnd | % Oil | 16:0 | 18:0 | 18:1 | 18:2 | GLA | 18:3 | STA | 20:0 | 20:1 | EDA | DGLA |
|---|---|---|---|---|---|---|---|---|---|---|---|---|---|---|
| | | 1203-13-1-5 | | 10.6 | 3.4 | 18.2 | 25.0 | | 7.6 | | 1.5 | 12.0 | 10.2 | 5.4 |
| HD1-10 | ALS | 1203-13-1-5 | 22.6 | 9.0 | 3.8 | 24.0 | 20.1 | 0.0 | 5.4 | 0.0 | 2.1 | 11.5 | 11.1 | 6.0 |
| HD1-4 | ALS | 1203-13-1-5 | 22.7 | 8.9 | 3.8 | 24.4 | 19.2 | 0.0 | 6.0 | 0.0 | 2.0 | 11.3 | 10.6 | 5.8 |
| HD1-2 | ALS | 1203-13-1-5 | 25.1 | 9.4 | 3.6 | 22.3 | 21.9 | 0.0 | 5.9 | 0.0 | 2.1 | 11.6 | 10.7 | 5.7 |
| HD1-6 | ALS | 1203-13-1-5 | 26.7 | 8.4 | 3.4 | 23.5 | 21.0 | 0.0 | 7.2 | 0.0 | 1.7 | 11.8 | 10.4 | 5.4 |
| HD1-8 | ALS | 1203-13-1-5 | 25.2 | 8.5 | 3.7 | 24.9 | 20.3 | 0.0 | 6.7 | 0.0 | 2.0 | 12.1 | 9.7 | 5.2 |
| HD1-1 | ALS | 1203-13-1-5 | 20.0 | 8.9 | 3.4 | 24.5 | 18.0 | 0.7 | 7.3 | 0.0 | 1.4 | 11.3 | 11.9 | 5.3 |
| HD1-5 | ALS | 1203-13-1-5 | 25.3 | 8.9 | 3.4 | 24.5 | 19.1 | 0.6 | 7.2 | 0.0 | 1.4 | 11.8 | 11.1 | 5.3 |
| HD1-7 | ALS | 1203-13-1-5 | 29.3 | 8.9 | 3.3 | 22.9 | 21.6 | 0.5 | 7.9 | 0.0 | 1.4 | 12.3 | 10.4 | 4.9 |
| HD1-3 | ALS | 1203-13-1-5 | 23.9 | 8.7 | 3.5 | 25.7 | 20.1 | 0.6 | 7.4 | 0.0 | 1.5 | 11.7 | 10.3 | 4.8 |
| HD1-9 | ALS | 1203-13-1-5 | 22.7 | 8.0 | 3.4 | 26.3 | 19.8 | 0.6 | 7.0 | 0.0 | 1.5 | 12.2 | 10.7 | 4.7 |
| Top5 Avg. | | | 24.5 | 8.8 | 3.7 | 23.8 | 20.5 | 0.0 | 6.2 | 0.0 | 2.0 | 11.7 | 10.5 | 5.7 |
| 1671-4 | GmMBOAT1 | 1203-13-1-5 | 17.9 | 9.2 | 3.4 | 20.9 | 16.6 | 0.0 | 3.8 | 0.0 | 2.2 | 6.3 | 14.9 | 13.5 |
| 1671-3 | GmMBOAT1 | 1203-13-1-5 | 18.7 | 8.9 | 3.2 | 22.8 | 15.3 | 0.6 | 4.5 | 0.0 | 1.5 | 5.4 | 16.1 | 14.1 |
| 1671-9 | GmMBOAT1 | 1203-13-1-5 | 23.6 | 8.7 | 3.2 | 22.5 | 15.8 | 0.5 | 5.5 | 0.0 | 1.4 | 7.0 | 14.8 | 12.4 |
| 1671-2 | GmMBOAT1 | 1203-13-1-5 | 20.8 | 8.3 | 3.3 | 24.7 | 17.0 | 0.0 | 4.1 | 0.0 | 1.9 | 6.7 | 13.9 | 12.0 |
| 1671-7 | GmMBOAT1 | 1203-13-1-5 | 19.9 | 8.8 | 3.5 | 24.2 | 14.3 | 0.6 | 4.6 | 0.0 | 1.4 | 6.9 | 15.4 | 12.3 |
| 1671-6 | GmMBOAT1 | 1203-13-1-5 | 22.4 | 8.1 | 3.4 | 22.3 | 16.6 | 0.0 | 3.9 | 0.0 | 2.0 | 6.9 | 16.0 | 11.4 |
| 1671-10 | GmMBOAT1 | 1203-13-1-5 | 24.9 | 8.3 | 3.6 | 23.0 | 17.6 | 0.0 | 5.0 | 0.0 | 2.0 | 7.7 | 13.6 | 10.7 |
| 1671-5 | GmMBOAT1 | 1203.13-1-5 | 16.0 | 8.4 | 3.3 | 25.0 | 16.6 | 0.6 | 5.1 | 0.0 | 1.5 | 7.7 | 14.7 | 10.3 |
| 1671-1 | GmMBOAT1 | 1203-13-1-5 | 27.0 | 7.6 | 3.3 | 23.3 | 19.0 | 0.4 | 6.0 | 0.6 | 1.6 | 10.0 | 13.4 | 8.5 |
| 1671-8 | GmMBOAT1 | 1203-13-1-5 | 24.9 | 9.8 | 3.4 | 23.3 | 21.4 | 0.0 | 5.9 | 0.0 | 1.8 | 11.0 | 10.9 | 5.7 |
| Top5 Avg. | | | 20.2 | 8.8 | 3.3 | 23.0 | 15.8 | 0.3 | 4.5 | 0.0 | 1.7 | 6.4 | 15.0 | 12.9 |
| 1672-6 | GmMBOAT2 | 1203-13-1-5 | 22.4 | 7.8 | 3.5 | 21.6 | 15.0 | 0.0 | 3.7 | 1.6 | 3.1 | 7.4 | 13.2 | 9.5 |
| 1672-4 | GmMBOAT2 | 1203-13-1-5 | 20.2 | 8.1 | 3.3 | 20.8 | 15.6 | 0.0 | 3.4 | 1.4 | 2.7 | 7.1 | 14.8 | 10.1 |
| 1672-8 | GmMBOAT2 | 1203-13-1-5 | 23.2 | 8.2 | 3.4 | 23.5 | 15.3 | 0.0 | 4.0 | 0.7 | 2.2 | 8.3 | 14.1 | 8.8 |
| 1672-10 | GmMBOAT2 | 1203-13-1-5 | 23.3 | 7.9 | 3.5 | 24.6 | 17.3 | 0.0 | 4.4 | 0.6 | 2.5 | 8.8 | 13.1 | 7.7 |
| 1672-7 | GmMBOAT2 | 1203-13-1-5 | 19.8 | 8.1 | 3.4 | 21.5 | 17.6 | 0.8 | 6.5 | 0.8 | 1.2 | 8.2 | 14.3 | 9.8 |
| 1672-5 | GmMBOAT2 | 1203-13-1-5 | 19.8 | 8.4 | 3.5 | 20.3 | 17.4 | 0.9 | 6.3 | 0.4 | 1.3 | 7.9 | 14.4 | 9.4 |
| 1672-3 | GmMBOAT2 | 1203-13-1-5 | 20.0 | 8.3 | 3.3 | 20.0 | 19.3 | 0.7 | 7.0 | 0.4 | 1.2 | 9.0 | 14.1 | 8.9 |
| 1672-2 | GmMBOAT2 | 1203-13-1-5 | 23.7 | 7.4 | 3.0 | 23.2 | 18.5 | 0.0 | 5.6 | 1.0 | 2.5 | 9.6 | 12.6 | 8.1 |

TABLE 69-continued

Fatty acid profile of T2 seed from events expressing MBOATs in
DGLA/ETA-expressing transgenic event 1203-13-1-5 (EgD9Elo-EaD8Des fusion)
T2 seed for 1203 (EgD9Elo-EaD8Des fusion) background event transformed with various MBOATs

| | | | | | | | | | | | | |
|---|---|---|---|---|---|---|---|---|---|---|---|---|
| 1672-1 | GmMBOAT2 | 1203-13-1-5 | 22.1 | 8.8 | 3.5 | 22.9 | 19.4 | 0.8 | 8.1 | 0.5 | 1.1 | 11.7 | 10.9 | 5.6 |
| 1672-9 | GmMBOAT2 | 1203-13-1-5 | 22.0 | 8.8 | 4.2 | 23.1 | 19.9 | 0.8 | 6.7 | 0.0 | 1.1 | 11.5 | 11.3 | 5.6 |
| Top5 Avg. | | | 21.8 | 8.0 | 3.4 | 22.4 | 16.2 | 0.2 | 4.4 | 1.0 | 2.3 | 8.0 | 13.9 | 9.2 |
| 1673-10 | CoLPCAT | 1203-13-1-5 | 19.6 | 9.5 | 3.6 | 22.7 | 17.0 | 1.1 | 3.8 | 0.0 | 2.0 | 8.8 | 14.4 | 9.1 |
| 1673-9 | CoLPCAT | 1203-13-1-5 | 19.3 | 9.3 | 3.1 | 22.7 | 16.3 | 0.8 | 5.4 | 0.0 | 1.5 | 9.2 | 15.0 | 9.2 |
| 1673-5 | CoLPCAT | 1203-13-1-5 | 21.9 | 9.3 | 3.3 | 22.3 | 17.2 | 0.6 | 5.4 | 0.0 | 1.5 | 8.7 | 15.0 | 9.1 |
| 1673-4 | CoLPCAT | 1203-13-1-5 | 19.8 | 8.6 | 3.7 | 25.2 | 16.5 | 0.8 | 4.3 | 0.0 | 2.1 | 8.6 | 13.4 | 8.2 |
| 1673-3 | CoLPCAT | 1203-13-1-5 | 23.1 | 8.6 | 3.6 | 24.1 | 17.6 | 0.5 | 5.7 | 0.6 | 1.5 | 9.9 | 13.2 | 7.4 |
| 1673-8 | CoLPCAT | 1203-13-1-5 | 22.7 | 8.6 | 3.5 | 25.2 | 18.9 | 0.0 | 5.5 | 0.0 | 1.9 | 9.9 | 12.1 | 7.0 |
| 1673-7 | CoLPCAT | 1203-13-1-5 | 22.3 | 8.4 | 3.6 | 25.1 | 17.1 | 0.6 | 6.1 | 0.0 | 1.5 | 10.2 | 13.5 | 7.0 |
| 1673-6 | CoLPCAT | 1203-13-1-5 | 26.5 | 7.9 | 3.5 | 24.6 | 19.9 | 0.0 | 6.3 | 0.0 | 1.9 | 11.3 | 11.3 | 6.0 |
| 1673-1 | CoLPCAT | 1203-13-1-5 | 22.7 | 8.2 | 3.6 | 27.1 | 17.8 | 0.5 | 6.7 | 0.0 | 1.5 | 10.4 | 11.9 | 5.9 |
| 1673-11 | CoLPCAT | 1203-13-1-5 | 26.1 | 8.2 | 3.5 | 24.0 | 17.8 | 0.5 | 7.4 | 0.7 | 1.5 | 11.2 | 12.2 | 5.9 |
| 1673-2 | CoLPCAT | 1203-13-1-5 | 22.7 | 9.0 | 3.4 | 23.0 | 21.5 | 0.9 | 6.5 | 0.0 | 1.9 | 11.5 | 10.2 | 5.5 |
| Top5 Avg. | | | 20.7 | 9.1 | 3.5 | 23.4 | 16.9 | 0.7 | 4.9 | 0.1 | 1.7 | 9.0 | 14.2 | 8.6 |
| 1674-2 | McLPCAT | 1203-13-1-5 | 19.9 | 9.5 | 3.1 | 19.4 | 13.5 | 0.6 | 4.4 | 0.0 | 1.6 | 4.7 | 17.8 | 14.9 |
| 1674-4 | McLPCAT | 1203-13-1-5 | 19.8 | 8.3 | 3.0 | 20.8 | 15.8 | 0.5 | 5.1 | 0.8 | 1.6 | 6.5 | 16.3 | 12.2 |
| 1674-13 | McLPCAT | 1203-13-1-5 | 21.3 | 8.1 | 3.3 | 23.1 | 16.7 | 0.0 | 4.4 | 0.0 | 2.0 | 6.4 | 15.0 | 11.3 |
| 1674-1 | McLPCAT | 1203-13-1-5 | 18.2 | 8.5 | 3.5 | 21.0 | 17.2 | 0.0 | 3.7 | 0.0 | 2.4 | 7.5 | 15.2 | 11.5 |
| 1674-7 | McLPCAT | 1203-13-1-5 | 23.3 | 9.1 | 3.4 | 22.6 | 16.8 | 0.0 | 4.5 | 0.0 | 2.0 | 7.9 | 14.4 | 10.5 |
| 1674-10 | McLPCAT | 1203-13-1-5 | 20.9 | 8.8 | 3.6 | 18.9 | 16.2 | 0.7 | 5.2 | 0.7 | 1.6 | 8.3 | 16.7 | 10.7 |
| 1674-5 | McLPCAT | 1203-13-1-5 | 21.9 | 8.9 | 3.7 | 22.9 | 16.6 | 0.0 | 3.7 | 0.0 | 2.1 | 7.5 | 15.8 | 10.4 |
| 1674-3 | McLPCAT | 1203-13-1-5 | 22.3 | 8.4 | 3.9 | 24.4 | 15.8 | 0.0 | 3.5 | 0.0 | 2.2 | 8.1 | 14.9 | 9.6 |
| 1674-12 | McLPCAT | 1203-13-1-5 | 19.7 | 9.0 | 3.4 | 23.6 | 15.7 | 0.7 | 4.8 | 0.0 | 1.5 | 7.6 | 16.3 | 9.9 |
| 1674-6 | McLPCAT | 1203-13-1-5 | 26.7 | 8.0 | 3.3 | 21.7 | 16.7 | 0.5 | 5.9 | 0.7 | 1.4 | 9.2 | 15.4 | 8.9 |
| 1674-9 | McLPCAT | 1203-13-1-5 | 21.4 | 8.5 | 4.0 | 24.5 | 19.0 | 0.0 | 4.9 | 0.0 | 2.5 | 8.5 | 12.5 | 7.8 |
| 1674-11 | McLPCAT | 1203-13-1-5 | 19.2 | 10.3 | 4.1 | 26.1 | 16.5 | 0.0 | 4.3 | 0.0 | 2.6 | 8.7 | 11.6 | 7.9 |
| 1674-14 | McLPCAT | 1203-13-1-5 | 21.7 | 9.4 | 3.5 | 27.1 | 19.6 | 0.6 | 6.8 | 0.0 | 1.4 | 10.0 | 10.7 | 5.3 |
| 1674-8 | McLPCAT | 1203-13-1-5 | 27.7 | 8.5 | 3.2 | 22.4 | 21.4 | 0.5 | 10.0 | 0.0 | 1.4 | 12.3 | 9.3 | 4.3 |
| Top5 Avg. | | | 20.5 | 8.7 | 3.2 | 21.4 | 16.0 | 0.2 | 4.4 | 0.2 | 1.9 | 6.6 | 15.7 | 12.1 |
| 1845-11 | EuphMBOAT | 1203-13-1-5 | 22.8 | 10.1 | 3.0 | 20.2 | 15.2 | 0.5 | 7.6 | 0.4 | 1.2 | 8.1 | 12.9 | 9.9 |
| 1845-12 | EuphMBOAT | 1203-13-1-5 | 21.3 | 10.4 | 3.2 | 21.5 | 16.3 | 0.5 | 6.6 | 0.4 | 1.3 | 8.4 | 13.1 | 9.1 |
| 1845-10 | EuphMBOAT | 1203-13-1-5 | 23.3 | 10.3 | 3.0 | 19.8 | 18.9 | 0.5 | 7.5 | 0.9 | 1.3 | 9.0 | 11.9 | 8.3 |
| 1845-5 | EuphMBOAT | 1203-13-1-5 | 20.9 | 9.8 | 3.1 | 21.4 | 17.2 | 0.4 | 8.0 | 0.7 | 1.3 | 8.6 | 12.3 | 8.2 |
| 1845-6 | EuphMBOAT | 1203-13-1-5 | 31.0 | 10.1 | 3.1 | 20.4 | 19.1 | 0.3 | 6.8 | 0.6 | 1.2 | 9.1 | 13.0 | 8.4 |
| 1845-4 | EuphMBOAT | 1203-13-1-5 | 25.8 | 9.6 | 3.0 | 20.0 | 18.6 | 0.6 | 8.3 | 0.7 | 1.2 | 9.3 | 12.2 | 7.9 |
| 1845-14 | EuphMBOAT | 1203-13-1-5 | 26.9 | 10.2 | 3.1 | 21.0 | 19.1 | 0.6 | 7.1 | 0.3 | 1.2 | 9.1 | 12.1 | 7.8 |
| 1845-9 | EuphMBOAT | 1203-13-1-5 | 29.2 | 9.2 | 2.8 | 17.3 | 20.5 | 0.4 | 11.5 | 0.6 | 1.2 | 9.9 | 10.6 | 7.2 |
| 1845-16 | EuphMBOAT | 1203-13-1-5 | 21.4 | 9.8 | 3.3 | 21.1 | 17.7 | 0.4 | 7.8 | 0.8 | 1.4 | 9.4 | 12.3 | 7.3 |
| 1845-2 | EuphMBOAT | 1203-13-1-5 | 26.6 | 10.6 | 3.1 | 20.6 | 20.0 | 0.5 | 7.6 | 0.3 | 1.2 | 9.1 | 11.5 | 7.4 |
| 1845-7 | EuphMBOAT | 1203-13-1-5 | 25.2 | 8.9 | 3.1 | 22.0 | 17.5 | 0.3 | 9.2 | 0.7 | 1.3 | 9.2 | 11.8 | 7.0 |
| 1845-15 | EuphMBOAT | 1203-13-1-5 | 28.2 | 9.7 | 2.9 | 19.5 | 20.1 | 0.5 | 8.8 | 0.7 | 1.2 | 9.9 | 11.3 | 7.1 |
| 1845-8 | EuphMBOAT | 1203-13-1-5 | 30.2 | 9.4 | 3.0 | 18.4 | 20.0 | 0.4 | 10.3 | 0.6 | 1.2 | 10.0 | 11.1 | 6.9 |
| 1845-3 | EuphMBOAT | 1203-13-1-5 | 25.1 | 9.1 | 3.0 | 20.7 | 19.3 | 0.3 | 10.2 | 0.2 | 1.3 | 9.3 | 11.3 | 6.6 |
| 1845-1 | EuphMBOAT | 1203-13-1-5 | 30.9 | 10.2 | 3.1 | 18.6 | 21.6 | 0.4 | 9.3 | 0.6 | 1.2 | 10.2 | 10.6 | 6.4 |
| 1845-13 | EuphMBOAT | 1203-13-1-5 | 27.3 | 9.3 | 3.0 | 22.5 | 20.5 | 0.4 | 8.4 | 0.8 | 1.2 | 9.7 | 10.9 | 6.3 |
| Top5 Avg. | | | 23.8 | 10.2 | 3.1 | 20.7 | 17.3 | 0.4 | 7.3 | 0.6 | 1.2 | 8.7 | 12.6 | 8.8 |

| Event # | MBOAT | Bkgrnd | ERA | ETA | LA + ALA | EDA + ERA | DGLA + ETA | % D12Des | % D9Elo | % D8Des |
|---|---|---|---|---|---|---|---|---|---|---|
| | | 1203-13-1-5 | 4.4 | 1.4 | 32.6 | 14.6 | 6.9 | 75% | 40% | 32% |
| HD1-10 | ALS | 1203-13-1-5 | 4.9 | 2.2 | 25.6 | 15.9 | 8.2 | 67% | 49% | 34% |
| HD1-4 | ALS | 1203-13-1-5 | 4.9 | 2.2 | 25.1 | 15.6 | 8.0 | 67% | 48% | 34% |
| HD1-2 | ALS | 1203-13-1-5 | 4.5 | 2.2 | 27.8 | 15.3 | 7.9 | 70% | 45% | 34% |
| HD1-6 | ALS | 1203-13-1-5 | 4.8 | 2.3 | 28.3 | 15.2 | 7.7 | 68% | 45% | 34% |
| HD1-8 | ALS | 1203-13-1-5 | 4.6 | 2.3 | 27.0 | 14.3 | 7.5 | 66% | 45% | 35% |

TABLE 69-continued

Fatty acid profile of T2 seed from events expressing MBOATs in
DGLA/ETA-expressing transgenic event 1203-13-1-5 (EgD9Elo-EaD8Des fusion)
T2 seed for 1203 (EgD9Elo-EaD8Des fusion) background event transformed with various MBOATs

| | | | | | | | | | | |
|---|---|---|---|---|---|---|---|---|---|---|
| HD1-1 | ALS | 1203-13-1-5 | 5.6 | 1.8 | 25.3 | 17.5 | 7.1 | 67% | 49% | 29% |
| HD1-5 | ALS | 1203-13-1-5 | 5.1 | 1.6 | 26.3 | 16.2 | 6.9 | 67% | 47% | 30% |
| HD1-7 | ALS | 1203-13-1-5 | 4.3 | 1.5 | 29.4 | 14.7 | 6.4 | 69% | 42% | 30% |
| HD1-3 | ALS | 1203-13-1-5 | 4.2 | 1.5 | 27.5 | 14.5 | 6.3 | 65% | 43% | 30% |
| HD1-9 | ALS | 1203-13-1-5 | 4.2 | 1.5 | 26.8 | 14.9 | 6.2 | 65% | 44% | 29% |
| Top5 Avg. | | | 4.7 | 2.2 | 26.8 | 15.2 | 7.9 | 68% | 46% | 34% |
| 1671-4 | GmMBOAT1 | 1203-13-1-5 | 4.7 | 4.5 | 20.5 | 19.5 | 18.1 | 74% | 65% | 48% |
| 1671-3 | GmMBOAT1 | 1203-13-1-5 | 3.6 | 3.9 | 19.9 | 19.7 | 18.0 | 72% | 65% | 48% |
| 1671-9 | GmMBOAT1 | 1203-13-1-5 | 4.6 | 3.8 | 21.3 | 19.3 | 16.2 | 72% | 63% | 46% |
| 1671-2 | GmMBOAT1 | 1203-13-1-5 | 4.0 | 4.2 | 21.1 | 17.9 | 16.2 | 69% | 62% | 48% |
| 1671-7 | GmMBOAT1 | 1203-13-1-5 | 4.5 | 3.6 | 18.9 | 19.8 | 15.9 | 69% | 65% | 44% |
| 1671-6 | GmMBOAT1 | 1203-13-1-5 | 4.7 | 3.6 | 20.5 | 20.7 | 15.0 | 72% | 64% | 42% |
| 1671-10 | GmMBOAT1 | 1203-13-1-5 | 4.6 | 3.8 | 22.7 | 18.2 | 14.5 | 71% | 59% | 44% |
| 1671-5 | GmMBOAT1 | 1203.13-1-5 | 4.2 | 2.5 | 21.7 | 18.9 | 12.8 | 68% | 59% | 40% |
| 1671-1 | GmMBOAT1 | 1203-13-1-5 | 4.0 | 2.3 | 25.0 | 17.4 | 10.7 | 70% | 53% | 38% |
| 1671-8 | GmMBOAT1 | 1203-13-1-5 | 4.7 | 2.1 | 27.3 | 15.5 | 7.8 | 68% | 46% | 33% |
| Top5 Avg. | | | 4.3 | 4.0 | 20.3 | 19.3 | 16.9 | 71% | 64% | 47% |
| 1672-6 | GmMBOAT2 | 1203-13-1-5 | 4.4 | 9.1 | 18.7 | 17.6 | 18.6 | 72% | 66% | 51% |
| 1672-4 | GmMBOAT2 | 1203-13-1-5 | 4.5 | 8.4 | 18.9 | 19.3 | 18.5 | 73% | 67% | 49% |
| 1672-8 | GmMBOAT2 | 1203-13-1-5 | 4.8 | 6.7 | 19.4 | 18.9 | 15.4 | 70% | 64% | 45% |
| 1672-10 | GmMBOAT2 | 1203-13-1-5 | 4.2 | 5.5 | 21.7 | 17.3 | 13.2 | 68% | 59% | 43% |
| 1672-7 | GmMBOAT2 | 1203-13-1-5 | 4.5 | 3.3 | 24.1 | 18.7 | 13.1 | 72% | 57% | 41% |
| 1672-5 | GmMBOAT2 | 1203-13-1-5 | 4.9 | 3.1 | 23.7 | 19.2 | 12.5 | 73% | 57% | 39% |
| 1672-3 | GmMBOAT2 | 1203-13-1-5 | 4.9 | 3.1 | 26.3 | 18.9 | 12.0 | 74% | 54% | 39% |
| 1672-2 | GmMBOAT2 | 1203-13-1-5 | 4.7 | 3.9 | 24.1 | 17.2 | 12.0 | 70% | 55% | 41% |
| 1672-1 | GmMBOAT2 | 1203-13-1-5 | 4.7 | 2.2 | 27.5 | 15.6 | 7.7 | 69% | 46% | 33% |
| 1672-9 | GmMBOAT2 | 1203-13-1-5 | 4.8 | 2.1 | 26.6 | 16.1 | 7.7 | 69% | 47% | 32% |
| Top5 Avg. | | | 4.5 | 6.6 | 20.5 | 18.4 | 15.8 | 71% | 62% | 46% |
| 1673-10 | CoLPCAT | 1203-13-1-5 | 5.2 | 2.8 | 20.8 | 19.6 | 11.9 | 70% | 60% | 38% |
| 1673-9 | CoLPCAT | 1203-13-1-5 | 4.8 | 2.8 | 21.7 | 19.8 | 11.9 | 70% | 59% | 38% |
| 1673-5 | CoLPCAT | 1203-13-1-5 | 4.8 | 2.7 | 22.7 | 19.8 | 11.8 | 71% | 58% | 37% |
| 1673-4 | CoLPCAT | 1203-13-1-5 | 4.8 | 2.9 | 20.8 | 18.3 | 11.1 | 67% | 59% | 38% |
| 1673-3 | CoLPCAT | 1203-13-1-5 | 4.5 | 2.2 | 23.3 | 17.7 | 9.6 | 68% | 54% | 35% |
| 1673-8 | CoLPCAT | 1203-13-1-5 | 4.8 | 2.6 | 24.4 | 17.0 | 9.6 | 67% | 52% | 36% |
| 1673-7 | CoLPCAT | 1203-13-1-5 | 4.9 | 2.1 | 23.1 | 18.4 | 9.1 | 67% | 54% | 33% |
| 1673-6 | CoLPCAT | 1203-13-1-5 | 4.7 | 2.4 | 26.2 | 16.1 | 8.4 | 67% | 48% | 34% |
| 1673-1 | CoLPCAT | 1203-13-1-5 | 4.5 | 1.9 | 24.5 | 16.4 | 7.8 | 64% | 50% | 32% |
| 1673-11 | CoLPCAT | 1203-13-1-5 | 5.3 | 1.9 | 25.2 | 17.5 | 7.8 | 68% | 50% | 31% |
| 1673-2 | CoLPCAT | 1203-13-1-5 | 4.7 | 2.0 | 27.9 | 14.9 | 7.6 | 69% | 45% | 34% |
| Top5 Avg. | | | 4.8 | 2.7 | 21.9 | 19.0 | 11.3 | 69% | 58% | 37% |
| 1674-2 | McLPCAT | 1203-13-1-5 | 5.9 | 4.6 | 17.9 | 23.7 | 19.5 | 76% | 71% | 45% |
| 1674-4 | McLPCAT | 1203-13-1-5 | 5.6 | 3.6 | 21.0 | 21.8 | 15.8 | 74% | 64% | 42% |
| 1674-13 | McLPCAT | 1203-13-1-5 | 5.5 | 4.2 | 21.1 | 20.6 | 15.5 | 71% | 63% | 43% |
| 1674-1 | McLPCAT | 1203-13-1-5 | 5.1 | 3.5 | 20.9 | 20.2 | 15.0 | 73% | 63% | 43% |
| 1674-7 | McLPCAT | 1203-13-1-5 | 5.4 | 3.3 | 21.3 | 19.8 | 13.8 | 71% | 61% | 41% |
| 1674-10 | McLPCAT | 1203-13-1-5 | 5.1 | 2.8 | 21.4 | 21.8 | 13.5 | 75% | 62% | 38% |
| 1674-5 | McLPCAT | 1203-13-1-5 | 5.3 | 3.1 | 20.3 | 21.1 | 13.5 | 71% | 63% | 39% |
| 1674-3 | McLPCAT | 1203-13-1-5 | 5.1 | 3.2 | 19.3 | 20.0 | 12.7 | 68% | 63% | 39% |
| 1674-12 | McLPCAT | 1203-13-1-5 | 5.0 | 2.5 | 20.5 | 21.3 | 12.5 | 70% | 62% | 37% |
| 1674-6 | McLPCAT | 1203-13-1-5 | 5.8 | 2.4 | 22.6 | 21.2 | 11.3 | 72% | 59% | 35% |
| 1674-9 | McLPCAT | 1203-13-1-5 | 4.7 | 3.0 | 23.8 | 17.2 | 10.9 | 68% | 54% | 39% |
| 1674-11 | McLPCAT | 1203-13-1-5 | 5.0 | 3.0 | 20.7 | 16.6 | 10.8 | 65% | 57% | 40% |
| 1674-14 | McLPCAT | 1203-13-1-5 | 4.1 | 1.6 | 26.4 | 14.8 | 6.9 | 64% | 45% | 32% |
| 1674-8 | McLPCAT | 1203-13-1-5 | 4.6 | 1.5 | 31.5 | 13.9 | 5.8 | 70% | 39% | 30% |
| Top5 Avg. | | | 5.5 | 3.8 | 20.4 | 21.2 | 15.9 | 73% | 64% | 43% |
| 1845-11 | EuphMBOAT | 1203-13-1-5 | 7.3 | 3.6 | 22.7 | 20.2 | 13.4 | 74% | 60% | 40% |
| 1845-12 | EuphMBOAT | 1203-13-1-5 | 6.5 | 2.9 | 22.8 | 19.6 | 12.0 | 72% | 58% | 38% |
| 1845-10 | EuphMBOAT | 1203-13-1-5 | 6.1 | 2.6 | 26.5 | 18.0 | 10.9 | 74% | 52% | 38% |
| 1845-5 | EuphMBOAT | 1203-13-1-5 | 6.3 | 2.7 | 25.2 | 18.6 | 10.9 | 72% | 54% | 37% |

TABLE 69-continued

Fatty acid profile of T2 seed from events expressing MBOATs in
DGLA/ETA-expressing transgenic event 1203-13-1-5 (EgD9Elo-EaD8Des fusion)
T2 seed for 1203 (EgD9Elo-EaD8Des fusion) background event transformed with various MBOATs

| | | | | | | | | | | |
|---|---|---|---|---|---|---|---|---|---|---|
| 1845-6 | EuphMBOAT | 1203-13-1-5 | 5.6 | 2.2 | 25.9 | 18.5 | 10.6 | 73% | 53% | 36% |
| 1845-4 | EuphMBOAT | 1203-13-1-5 | 6.2 | 2.5 | 26.9 | 18.4 | 10.3 | 74% | 52% | 36% |
| 1845-14 | EuphMBOAT | 1203-13-1-5 | 5.9 | 2.4 | 26.2 | 18.0 | 10.2 | 72% | 52% | 36% |
| 1845-9 | EuphMBOAT | 1203-13-1-5 | 6.3 | 2.6 | 31.9 | 16.9 | 9.8 | 77% | 46% | 37% |
| 1845-16 | EuphMBOAT | 1203-13-1-5 | 6.3 | 2.4 | 25.5 | 18.6 | 9.7 | 72% | 53% | 34% |
| 1845-2 | EuphMBOAT | 1203-13-1-5 | 5.8 | 2.2 | 27.6 | 17.3 | 9.6 | 73% | 49% | 36% |
| 1845-7 | EuphMBOAT | 1203-13-1-5 | 6.5 | 2.5 | 26.7 | 18.3 | 9.5 | 71% | 51% | 34% |
| 1845-15 | EuphMBOAT | 1203-13-1-5 | 5.9 | 2.3 | 28.9 | 17.3 | 9.5 | 74% | 48% | 35% |
| 1845-8 | EuphMBOAT | 1203-13-1-5 | 6.3 | 2.3 | 30.3 | 17.4 | 9.2 | 76% | 47% | 35% |
| 1845-3 | EuphMBOAT | 1203-13-1-5 | 6.2 | 2.5 | 29.5 | 17.4 | 9.1 | 73% | 47% | 34% |
| 1845-1 | EuphMBOAT | 1203-13-1-5 | 5.6 | 2.0 | 30.9 | 16.1 | 8.4 | 75% | 44% | 34% |
| 1845-13 | EuphMBOAT | 1203-13-1-5 | 5.1 | 1.9 | 29.0 | 16.0 | 8.2 | 70% | 45% | 34% |
| Top5 Avg. | | | 6.4 | 2.8 | 24.6 | 19.0 | 11.6 | 73% | 55% | 38% |

TABLE 70

Fatty acid profile of T2 seed from events expressing MBOATs in
ARA/EPA-expressing event 1193-5-4-6 (EaD9Elo/EaD8Des/EaD5Des)
T2 seed for 1193 (EaD9Elo/EaD8Des/EaD5Des) background event transformed with various MBOATs

| Event # | MBOAT | Bkgrnd | % Oil | 16:0 | 18:0 | 18:1 | 18:2 | GLA | 18:3 | STA | 20:0 | 20:1 | EDA | 20:3 (5, 11, 14) | DGLA | ARA |
|---|---|---|---|---|---|---|---|---|---|---|---|---|---|---|---|---|
| | | 1193-5-4-6 | | 8.3 | 3.2 | 16.4 | 20.5 | 0.0 | 7.6 | 0.0 | 1.5 | 13.0 | 14.6 | | 0.5 | 6.7 |
| HD1-1 | ALS | 1193-5-4-6 | 27.1 | 6.7 | 3.0 | 16.7 | 16.2 | 0.0 | 10.7 | 0.0 | 1.1 | 12.9 | 14.9 | 0.9 | 0.7 | 7.4 |
| HD1-6 | ALS | 1193-5-4-6 | 21.0 | 7.9 | 3.5 | 18.1 | 16.0 | 0.0 | 5.8 | 2.0 | 3.1 | 11.1 | 16.4 | 0.0 | 0.0 | 7.0 |
| HD1-9 | ALS | 1193-5-4-6 | 22.8 | 6.8 | 3.3 | 18.6 | 15.1 | 0.6 | 9.9 | 0.0 | 1.1 | 12.0 | 15.4 | 0.8 | 0.7 | 7.1 |
| HD1-7 | ALS | 1193-5-4-6 | 26.6 | 6.7 | 3.3 | 16.8 | 16.5 | 0.5 | 8.3 | 0.3 | 1.5 | 13.0 | 15.6 | 0.9 | 0.5 | 6.9 |
| HD1-5 | ALS | 1193-5-4-6 | 28.4 | 6.9 | 3.2 | 16.2 | 18.5 | 0.3 | 8.6 | 0.3 | 1.2 | 13.7 | 14.9 | 0.8 | 0.5 | 7.0 |
| HD1-3 | ALS | 1193-5-4-6 | 27.6 | 6.9 | 3.4 | 17.4 | 17.1 | 0.5 | 9.1 | 0.0 | 1.3 | 13.7 | 14.6 | 0.9 | 0.6 | 6.5 |
| HD1-10 | ALS | 1193-5-4-6 | 25.0 | 6.6 | 2.9 | 16.9 | 16.7 | 0.9 | 6.0 | 0.8 | 2.1 | 11.5 | 15.8 | 0.7 | 0.0 | 6.3 |
| HD1-4 | ALS | 1193-5-4-6 | 24.3 | 6.6 | 3.0 | 18.4 | 16.0 | 0.8 | 6.8 | 0.6 | 1.8 | 12.9 | 15.0 | 0.6 | 0.0 | 5.9 |
| HD1-8 | ALS | 1193-5-4-6 | 27.5 | 7.1 | 3.5 | 19.0 | 16.8 | 0.0 | 6.4 | 1.2 | 2.5 | 12.5 | 16.1 | 0.7 | 0.0 | 5.9 |
| HD1-2 | ALS | 1193-5-4-6 | 31.4 | 6.5 | 3.3 | 19.0 | 16.8 | 0.4 | 7.4 | 1.1 | 2.4 | 12.9 | 13.6 | 0.1 | 0.0 | 4.4 |
| | | | 25.2 | 7.0 | 3.3 | 17.3 | 16.5 | 0.3 | 8.7 | 0.5 | 1.6 | 12.6 | 15.4 | 0.7 | 0.5 | 7.1 |
| 1671-1 | GmMBOAT1 | 1193-5-4-6 | 19.5 | 7.3 | 3.0 | 15.9 | 8.4 | 1.7 | 1.9 | 0.0 | 1.2 | 4.4 | 20.9 | 2.8 | 0.9 | 21.2 |
| 1671-18 | GmMBOAT1 | 1193-5-4-6 | 25.1 | 8.7 | 2.9 | 18.1 | 8.1 | 0.0 | 3.3 | 0.0 | 1.1 | 5.7 | 20.2 | 0.9 | 0.6 | 19.1 |
| 1671-13 | GmMBOAT1 | 1193-5-4-6 | 31.6 | 7.8 | 3.0 | 14.9 | 10.1 | 0.0 | 4.0 | 0.0 | 1.2 | 5.5 | 20.1 | 2.1 | 0.5 | 19.1 |
| 1671-15 | GmMBOAT1 | 1193-5-4-6 | 31.6 | 7.6 | 3.0 | 14.3 | 10.2 | 0.0 | 4.2 | 0.0 | 1.3 | 5.4 | 21.3 | 2.6 | 0.4 | 17.5 |
| 1671-2 | GmMBOAT1 | 1193-5-4-6 | 22.6 | 6.8 | 3.4 | 20.1 | 8.1 | 1.4 | 1.8 | 0.0 | 1.7 | 5.1 | 21.8 | 1.8 | 0.8 | 18.2 |
| 1671-7 | GmMBOAT1 | 1193-5-4-6 | 26.2 | 6.8 | 3.1 | 20.2 | 7.3 | 1.1 | 2.1 | 0.0 | 1.3 | 5.0 | 22.4 | 2.3 | 0.6 | 17.7 |
| 1671-16 | GmMBOAT1 | 1193-5-4-6 | 25.7 | 8.5 | 3.1 | 14.4 | 11.3 | 0.0 | 5.0 | 0.0 | 1.4 | 5.6 | 19.4 | 2.3 | 0.4 | 16.1 |
| 1671-17 | GmMBOAT1 | 1193-5-4-6 | 22.0 | 8.7 | 3.2 | 17.7 | 11.2 | 0.0 | 4.1 | 0.0 | 1.3 | 5.2 | 20.0 | 1.8 | 0.6 | 16.0 |
| 1671-14 | GmMBOAT1 | 1193-5-4-6 | 34.1 | 7.5 | 3.0 | 13.4 | 12.4 | 0.0 | 5.5 | 0.0 | 1.2 | 6.9 | 20.0 | 1.8 | 0.4 | 15.5 |
| 1671-12 | GmMBOAT1 | 1193-5-4-6 | 19.7 | 8.9 | 3.1 | 16.1 | 12.4 | 0.4 | 5.3 | 0.0 | 1.3 | 6.8 | 18.2 | 1.2 | 0.8 | 14.9 |
| 1671-5 | GmMBOAT1 | 1193-5-4-6 | 28.2 | 7.0 | 3.0 | 20.0 | 10.4 | 0.8 | 3.8 | 0.0 | 1.2 | 8.0 | 21.3 | 1.0 | 0.5 | 14.8 |
| 1671-10 | GmMBOAT1 | 1193-5-4-6 | 26.7 | 6.6 | 3.3 | 20.4 | 10.6 | 1.1 | 3.2 | 0.0 | 1.5 | 7.1 | 20.3 | 1.5 | 0.8 | 14.8 |
| 1671-9 | GmMBOAT1 | 1193-5-4-6 | 22.5 | 6.4 | 2.9 | 19.2 | 11.0 | 1.1 | 4.1 | 0.0 | 1.3 | 8.3 | 19.8 | 1.3 | 0.6 | 14.1 |
| 1671-11 | GmMBOAT1 | 1193-5-4-6 | 30.8 | 6.4 | 3.1 | 19.7 | 9.9 | 0.8 | 3.2 | 0.0 | 1.4 | 7.3 | 22.1 | 1.6 | 0.5 | 14.3 |
| 1671-8 | GmMBOAT1 | 1193-5-4-6 | 23.4 | 6.8 | 3.5 | 19.9 | 11.2 | 0.9 | 3.0 | 0.0 | 1.8 | 8.0 | 21.0 | 1.1 | 0.9 | 13.4 |
| 1671-6 | GmMBOAT1 | 1193-5-4-6 | 26.3 | 6.5 | 3.4 | 20.5 | 11.1 | 0.9 | 3.2 | 0.0 | 1.7 | 7.1 | 21.5 | 2.0 | 0.8 | 12.0 |
| 1671-3 | GmMBOAT1 | 1193-5-4-6 | 28.5 | 6.5 | 3.1 | 19.5 | 13.2 | 0.7 | 5.4 | 0.0 | 1.4 | 10.7 | 18.3 | 1.1 | 0.5 | 10.3 |
| 1671-4 | GmMBOAT1 | 1193-5-4-6 | 33.7 | 6.4 | 3.1 | 16.8 | 19.4 | 0.3 | 8.9 | 0.0 | 1.6 | 14.0 | 14.2 | 1.0 | 0.5 | 5.2 |
| | | | 26.1 | 7.6 | 3.1 | 16.6 | 9.0 | 0.6 | 3.1 | 0.0 | 1.3 | 5.2 | 20.8 | 2.1 | 0.6 | 19.0 |
| 1672-13 | GmMBOAT2 | 1193-5-4-6 | 25.5 | 6.7 | 3.4 | 20.9 | 7.8 | 0.9 | 2.0 | 0.0 | 1.6 | 6.2 | 22.5 | 1.1 | 0.9 | 16.1 |
| 1672-2 | GmMBOAT2 | 1193-5-4-6 | 30.0 | 7.4 | 3.0 | 22.4 | 9.2 | 0.8 | 2.8 | 0.0 | 1.0 | 5.7 | 21.9 | 0.7 | 0.7 | 15.1 |
| 1672-11 | GmMBOAT2 | 1193-5-4-6 | 24.8 | 6.8 | 3.0 | 18.7 | 10.9 | 0.8 | 3.4 | 0.0 | 1.5 | 7.7 | 21.4 | 0.8 | 0.9 | 14.3 |
| 1672-5 | GmMBOAT2 | 1193-5-4-6 | 23.2 | 6.8 | 3.2 | 18.4 | 11.1 | 0.8 | 3.3 | 0.0 | 1.6 | 7.1 | 21.8 | 1.0 | 1.0 | 14.3 |
| 1672-10 | GmMBOAT2 | 1193-5-4-6 | 20.5 | 7.8 | 3.0 | 19.0 | 11.8 | 0.4 | 3.7 | 0.0 | 1.3 | 8.2 | 20.6 | 0.7 | 0.8 | 13.4 |
| 1672-9 | GmMBOAT2 | 1193-5-4-6 | 26.0 | 6.3 | 3.5 | 20.9 | 9.9 | 0.6 | 2.9 | 0.0 | 1.7 | 7.3 | 21.2 | 1.2 | 0.9 | 13.3 |
| 1672-16 | GmMBOAT2 | 1193-5-4-6 | 22.7 | 7.6 | 3.1 | 19.9 | 12.6 | 0.3 | 3.5 | 0.0 | 1.4 | 7.9 | 20.8 | 0.9 | 0.7 | 12.7 |
| 1672-7 | GmMBOAT2 | 1193-5-4-6 | 25.9 | 6.8 | 3.2 | 19.7 | 11.8 | 0.8 | 3.7 | 0.0 | 1.5 | 8.1 | 20.5 | 0.7 | 0.9 | 12.3 |
| 1672-14 | GmMBOAT2 | 1193-5-4-6 | 25.7 | 7.6 | 3.2 | 20.3 | 12.4 | 0.7 | 4.0 | 0.0 | 1.2 | 7.4 | 20.1 | 1.0 | 0.6 | 12.0 |
| 1672-8 | GmMBOAT2 | 1193-5-4-6 | 28.2 | 7.1 | 3.2 | 19.8 | 12.4 | 0.7 | 4.4 | 0.0 | 1.3 | 8.0 | 19.8 | 1.3 | 0.6 | 11.8 |
| 1672-12 | GmMBOAT2 | 1193-5-4-6 | 28.7 | 6.7 | 3.2 | 19.9 | 12.2 | 0.7 | 3.8 | 0.0 | 1.4 | 7.9 | 20.9 | 1.2 | 0.6 | 11.8 |
| 1672-4 | GmMBOAT2 | 1193-5-4-6 | 27.8 | 7.2 | 3.1 | 19.5 | 13.2 | 0.7 | 4.5 | 0.0 | 1.3 | 8.4 | 19.8 | 1.0 | 0.6 | 11.3 |
| 1672-6 | GmMBOAT2 | 1193-5-4-6 | 29.1 | 7.1 | 3.3 | 19.7 | 12.6 | 0.7 | 4.6 | 0.0 | 1.4 | 8.4 | 19.5 | 1.0 | 0.7 | 11.0 |
| 1672-1 | GmMBOAT2 | 1193-5-4-6 | 30.1 | 6.8 | 3.5 | 20.0 | 12.1 | 0.6 | 4.2 | 0.0 | 1.7 | 8.1 | 19.3 | 1.3 | 0.9 | 11.1 |

TABLE 70-continued

Fatty acid profile of T2 seed from events expressing MBOATs in
ARA/EPA-expressing event 1193-5-4-6 (EaD9Elo/EaD8Des/EaD5Des)
T2 seed for 1193 (EaD9Elo/EaD8Des/EaD5Des) background event transformed with various MBOATs

| 1672-15 | GmMBOAT2 | 1193-5-4-6 | 28.3 | 6.6 | 3.4 | 19.9 | 12.5 | 0.7 | 4.2 | 0.0 | 1.7 | 8.3 | 19.9 | 1.2 | 0.8 | 10.9 |
|---|---|---|---|---|---|---|---|---|---|---|---|---|---|---|---|---|
| 1672-3 | GmMBOAT2 | 1193-5-4-6 | 27.9 | 6.6 | 3.5 | 22.0 | 11.1 | 0.9 | 3.7 | 0.0 | 1.7 | 8.3 | 19.5 | 1.3 | 0.8 | 10.6 |
| | | | 24.8 | 7.1 | 3.1 | 19.9 | 10.2 | 0.7 | 3.0 | 0.0 | 1.4 | 7.0 | 21.6 | 0.9 | 0.8 | 14.7 |
| 1673-1 | CoMBOAT | 1193-5-4-6 | 31.4 | 6.8 | 3.2 | 18.6 | 11.0 | 0.6 | 3.3 | 0.0 | 1.5 | 6.8 | 22.1 | 1.1 | 0.8 | 13.8 |
| 1673-9 | CoMBOAT | 1193-5-4-6 | 28.9 | 6.8 | 3.3 | 20.7 | 12.3 | 0.7 | 4.5 | 0.0 | 1.6 | 8.8 | 19.3 | 0.7 | 0.8 | 10.4 |
| 1673-3 | CoMBOAT | 1193-5-4-6 | 28.8 | 7.3 | 3.4 | 17.2 | 14.5 | 0.6 | 5.1 | 0.0 | 1.7 | 9.3 | 19.0 | 0.8 | 0.7 | 10.2 |
| 1673-2 | CoMBOAT | 1193-5-4-6 | 23.4 | 7.2 | 3.1 | 20.7 | 13.4 | 0.7 | 4.9 | 0.0 | 1.4 | 8.7 | 18.7 | 1.0 | 0.6 | 9.9 |
| 1673-12 | CoMBOAT | 1193-5-4-6 | 33.3 | 7.2 | 3.3 | 17.7 | 14.4 | 0.5 | 5.1 | 0.0 | 1.5 | 8.8 | 20.0 | 1.1 | 0.5 | 9.9 |
| 1673-4 | CoMBOAT | 1193-5-4-6 | 25.7 | 7.2 | 3.1 | 20.0 | 15.1 | 0.7 | 6.1 | 0.0 | 1.3 | 9.7 | 16.9 | 0.9 | 0.6 | 8.8 |
| 1673-7 | CoMBOAT | 1193-5-4-6 | 24.9 | 6.8 | 3.2 | 18.8 | 14.4 | 0.8 | 5.6 | 0.0 | 1.6 | 9.3 | 18.2 | 1.0 | 1.0 | 9.2 |
| 1673-11 | CoMBOAT | 1193-5-4-6 | 28.2 | 6.6 | 3.4 | 20.2 | 13.2 | 0.7 | 4.9 | 0.0 | 1.7 | 9.0 | 19.1 | 1.1 | 0.8 | 9.1 |
| 1673-10 | CoMBOAT | 1193-5-4-6 | 25.5 | 6.8 | 3.0 | 18.8 | 14.5 | 0.3 | 6.1 | 0.0 | 1.5 | 11.1 | 17.7 | 0.6 | 0.7 | 8.5 |
| 1673-6 | CoMBOAT | 1193-5-4-6 | 28.6 | 6.6 | 3.3 | 18.3 | 15.3 | 0.2 | 6.4 | 0.0 | 1.6 | 11.1 | 17.9 | 1.1 | 0.5 | 8.0 |
| 1673-13 | CoMBOAT | 1193-5-4-6 | 27.9 | 6.9 | 3.3 | 18.4 | 16.7 | 0.6 | 6.3 | 0.0 | 1.7 | 10.5 | 17.3 | 1.1 | 0.7 | 7.5 |
| 1673-5 | CoMBOAT | 1193-5-4-6 | 29.9 | 6.7 | 3.4 | 18.3 | 16.5 | 0.6 | 6.9 | 0.0 | 1.7 | 11.8 | 16.2 | 1.0 | 0.7 | 6.6 |
| 1673-8 | CoMBOAT | 1193-5-4-6 | 29.6 | 6.8 | 2.9 | 16.4 | 18.7 | 0.4 | 9.2 | 0.0 | 1.5 | 12.7 | 15.1 | 1.2 | 0.4 | 5.3 |
| | | | 29.1 | 7.1 | 3.3 | 19.0 | 13.1 | 0.6 | 4.6 | 0.0 | 1.5 | 8.5 | 19.8 | 1.0 | 0.7 | 10.8 |
| 1674-6 | McMBOAT | 1193-5-4-6 | 32.0 | 6.8 | 3.4 | 20.1 | 9.4 | 0.6 | 2.5 | 0.0 | 1.6 | 5.8 | 23.3 | 1.3 | 0.9 | 14.4 |
| 1674-5 | McMBOAT | 1193-5-4-6 | 25.6 | 6.8 | 3.1 | 20.0 | 11.0 | 0.8 | 3.7 | 0.0 | 1.5 | 7.0 | 20.9 | 1.2 | 0.8 | 12.9 |
| 1674-7 | McMBOAT | 1193-5-4-6 | 22.1 | 7.1 | 3.3 | 21.2 | 11.2 | 0.9 | 4.0 | 0.0 | 1.4 | 8.1 | 19.2 | 0.8 | 1.0 | 11.7 |
| 1674-10 | McMBOAT | 1193-5-4-6 | 23.8 | 6.4 | 3.2 | 18.9 | 12.0 | 0.8 | 3.8 | 0.0 | 1.6 | 8.0 | 20.1 | 1.1 | 1.0 | 11.8 |
| 1674-11 | McMBOAT | 1193-5-4-6 | 29.2 | 6.9 | 3.3 | 17.5 | 12.1 | 0.2 | 4.4 | 0.0 | 1.6 | 8.4 | 21.2 | 1.2 | 0.8 | 11.9 |
| 1674-8 | McMBOAT | 1193-5-4-6 | 29.3 | 6.7 | 3.3 | 19.0 | 11.9 | 0.7 | 4.1 | 0.0 | 1.7 | 8.0 | 20.3 | 1.3 | 1.0 | 11.5 |
| 1674-12 | McMBOAT | 1193-5-4-6 | 30.4 | 6.7 | 3.2 | 17.3 | 13.3 | 0.6 | 4.3 | 0.0 | 1.6 | 7.2 | 21.0 | 1.8 | 0.9 | 11.4 |
| 1674-3 | McMBOAT | 1193-5-4-6 | 29.6 | 7.3 | 3.2 | 19.3 | 13.2 | 0.6 | 4.7 | 0.0 | 1.4 | 7.2 | 19.9 | 1.4 | 0.6 | 10.9 |
| 1674-1 | McMBOAT | 1193-5-4-6 | 31.8 | 7.0 | 3.1 | 19.1 | 13.3 | 0.6 | 4.8 | 0.0 | 1.4 | 7.2 | 19.9 | 1.7 | 0.6 | 10.5 |
| 1674-9 | McMBOAT | 1193-5-4-6 | 24.2 | 7.4 | 2.8 | 18.9 | 16.3 | 0.4 | 6.3 | 0.0 | 1.1 | 9.7 | 17.2 | 0.7 | 0.7 | 9.6 |
| 1674-2 | McMBOAT | 1193-5-4-6 | 29.5 | 6.4 | 3.5 | 20.7 | 17.6 | 0.6 | 6.5 | 0.0 | 1.8 | 12.9 | 15.3 | 0.7 | 0.7 | 5.7 |
| 1674-4 | McMBOAT | 1193-5-4-6 | 33.5 | 7.0 | 3.4 | 16.5 | 20.4 | 0.4 | 9.6 | 0.0 | 1.7 | 14.1 | 12.7 | 0.8 | 0.5 | 4.5 |
| | | | 26.5 | 6.8 | 3.2 | 19.5 | 11.1 | 0.7 | 3.7 | 0.0 | 1.5 | 7.5 | 20.9 | 1.1 | 0.9 | 12.5 |
| 1845-11 | EuphMBOAT | 1193-5-4-6 | 30.2 | 7.3 | 3.1 | 18.9 | 14.7 | 0.5 | 5.7 | 0.0 | 1.4 | 10.1 | 18.7 | 0.8 | 0.6 | 9.1 |
| 1845-5 | EuphMBOAT | 1193-5-4-6 | 23.4 | 7.4 | 2.8 | 19.6 | 14.5 | 0.4 | 5.8 | 0.0 | 1.4 | 11.6 | 17.4 | 0.6 | 0.7 | 8.5 |
| 1845-13 | EuphMBOAT | 1193-5-4-6 | 24.3 | 6.8 | 2.9 | 18.9 | 16.2 | 0.3 | 5.7 | 0.0 | 1.5 | 12.3 | 17.5 | 0.8 | 0.6 | 7.7 |
| 1845-6 | EuphMBOAT | 1193-5-4-6 | 26.3 | 7.1 | 3.4 | 21.0 | 14.7 | 0.7 | 5.6 | 0.0 | 1.8 | 10.7 | 17.3 | 1.0 | 0.8 | 7.1 |
| 1845-3 | EuphMBOAT | 1193-5-4-6 | 23.6 | 7.5 | 3.2 | 18.9 | 17.3 | 0.6 | 6.4 | 0.0 | 1.4 | 11.9 | 16.4 | 0.7 | 0.7 | 7.0 |
| 1845-12 | EuphMBOAT | 1193-5-4-6 | 28.7 | 6.3 | 3.2 | 18.6 | 16.5 | 0.6 | 6.7 | 0.0 | 1.7 | 11.9 | 16.6 | 0.9 | 0.7 | 6.9 |
| 1845-1 | EuphMBOAT | 1193-5-4-6 | 29.3 | 7.2 | 2.9 | 17.6 | 18.1 | 0.2 | 7.9 | 0.0 | 1.3 | 11.9 | 15.9 | 0.7 | 0.4 | 6.7 |
| 1845-10 | EuphMBOAT | 1193-5-4-6 | 28.8 | 6.4 | 3.3 | 19.7 | 16.5 | 0.6 | 6.7 | 0.0 | 1.7 | 12.2 | 15.9 | 0.8 | 0.8 | 6.5 |
| 1845-2 | EuphMBOAT | 1193-5-4-6 | 28.0 | 6.6 | 3.3 | 19.2 | 16.7 | 0.6 | 7.0 | 0.0 | 1.7 | 11.8 | 16.1 | 1.0 | 0.6 | 6.4 |
| 1845-4 | EuphMBOAT | 1193-5-4-6 | 30.4 | 7.0 | 3.5 | 20.5 | 16.1 | 0.5 | 6.3 | 0.0 | 1.6 | 12.5 | 15.5 | 0.5 | 0.8 | 6.4 |
| 1845-7 | EuphMBOAT | 1193-5-4-6 | 27.0 | 7.3 | 2.9 | 18.0 | 19.8 | 0.3 | 7.7 | 0.0 | 1.3 | 12.4 | 15.0 | 0.6 | 0.5 | 6.1 |
| 1845-8 | EuphMBOAT | 1193-5-4-6 | 31.7 | 6.7 | 3.3 | 18.2 | 18.0 | 0.5 | 7.6 | 0.0 | 1.6 | 12.4 | 15.3 | 0.9 | 0.6 | 6.0 |
| 1845-9 | EuphMBOAT | 1193-5-4-6 | 28.1 | 7.1 | 2.8 | 17.0 | 20.3 | 0.3 | 7.8 | 0.0 | 1.3 | 13.0 | 14.9 | 0.6 | 0.5 | 5.8 |
| 1845-14 | EuphMBOAT | 1193-5-4-6 | 29.1 | 6.8 | 3.5 | 18.2 | 19.6 | 0.5 | 7.9 | 0.0 | 1.9 | 13.3 | 14.9 | 0.9 | 0.0 | 5.1 |
| | | | 25.6 | 7.2 | 3.1 | 19.5 | 15.5 | 0.5 | 5.8 | 0.0 | 1.5 | 11.3 | 17.5 | 0.8 | 0.7 | 7.9 |

| Event # | MBOAT | Bkgrnd | ERA | 20:4 (5, 11, 14, 17) | ETA | EPA | LA + ALA | EDA + ERA | DGLA + ETA | ARA + EPA | % D12Des | % D9Elo | % D8Des | % D5Des |
|---|---|---|---|---|---|---|---|---|---|---|---|---|---|---|
| | | 1193-5-4-6 | 5.9 | | 0.0 | 1.9 | 28.1 | 20.4 | 0.5 | 8.6 | 78% | 51% | 31% | 95% |
| HD1-1 | ALS | 1193-5-4-6 | 6.4 | 0.0 | 0.0 | 2.3 | 26.9 | 21.4 | 0.7 | 9.7 | 78% | 54% | 33% | 93% |
| HD1-6 | ALS | 1193-5-4-6 | 6.8 | 0.0 | 0.0 | 2.3 | 21.8 | 23.2 | 0.0 | 9.3 | 75% | 60% | 29% | 100% |
| HD1-9 | ALS | 1193-5-4-6 | 6.5 | 0.0 | 0.0 | 2.1 | 25.0 | 21.9 | 0.7 | 9.2 | 75% | 56% | 31% | 93% |
| HD1-7 | ALS | 1193-5-4-6 | 6.5 | 0.6 | 0.0 | 2.1 | 24.8 | 22.1 | 0.5 | 9.1 | 77% | 56% | 30% | 95% |
| HD1-5 | ALS | 1193-5-4-6 | 5.9 | 0.0 | 0.0 | 2.0 | 27.1 | 20.7 | 0.5 | 8.9 | 78% | 53% | 31% | 94% |
| HD1-3 | ALS | 1193-5-4-6 | 6.1 | 0.0 | 0.0 | 2.0 | 26.2 | 20.7 | 0.6 | 8.5 | 76% | 53% | 30% | 93% |
| HD1-10 | ALS | 1193-5-4-6 | 6.1 | 4.6 | 0.0 | 2.1 | 22.7 | 21.9 | 0.0 | 8.4 | 76% | 57% | 28% | 100% |
| HD1-4 | ALS | 1193-5-4-6 | 6.6 | 2.8 | 0.0 | 2.2 | 22.9 | 21.7 | 0.0 | 8.2 | 74% | 57% | 27% | 100% |
| HD1-8 | ALS | 1193-5-4-6 | 6.3 | 0.0 | 0.0 | 2.0 | 23.2 | 22.4 | 0.0 | 7.9 | 74% | 57% | 26% | 100% |
| HD1-2 | ALS | 1193-5-4-6 | 6.0 | 4.7 | 0.0 | 1.5 | 24.2 | 19.6 | 0.0 | 5.9 | 72% | 51% | 23% | 100% |
| | | | 6.4 | 0.1 | 0.0 | 2.1 | 25.1 | 21.9 | 0.5 | 9.2 | 77% | 56% | 31% | 95% |
| 1671-1 | GmMBOAT1 | 1193-5-4-6 | 3.8 | 1.6 | 0.0 | 5.0 | 10.3 | 24.7 | 0.9 | 26.2 | 80% | 83% | 52% | 97% |
| 1671-18 | GmMBOAT1 | 1193-5-4-6 | 5.5 | 0.4 | 0.0 | 5.5 | 11.4 | 25.6 | 0.6 | 24.6 | 77% | 82% | 50% | 98% |
| 1671-13 | GmMBOAT1 | 1193-5-4-6 | 5.4 | 1.0 | 0.0 | 5.3 | 14.1 | 25.6 | 0.5 | 24.4 | 81% | 78% | 49% | 98% |
| 1671-15 | GmMBOAT1 | 1193-5-4-6 | 5.9 | 1.4 | 0.0 | 5.1 | 14.4 | 27.1 | 0.4 | 22.7 | 82% | 78% | 46% | 98% |
| 1671-2 | GmMBOAT1 | 1193-5-4-6 | 4.0 | 0.9 | 0.0 | 4.2 | 9.9 | 25.8 | 0.8 | 22.5 | 75% | 83% | 47% | 97% |
| 1671-7 | GmMBOAT1 | 1193-5-4-6 | 4.5 | 1.1 | 0.0 | 4.5 | 9.4 | 26.9 | 0.6 | 22.2 | 75% | 84% | 46% | 98% |
| 1671-16 | GmMBOAT1 | 1193-5-4-6 | 5.9 | 1.3 | 0.0 | 5.0 | 16.7 | 25.3 | 0.4 | 21.2 | 82% | 74% | 46% | 98% |
| 1671-17 | GmMBOAT1 | 1193-5-4-6 | 5.0 | 0.9 | 0.0 | 4.2 | 15.3 | 25.1 | 0.6 | 20.2 | 78% | 75% | 45% | 97% |
| 1671-14 | GmMBOAT1 | 1193-5-4-6 | 6.9 | 0.9 | 0.0 | 4.5 | 18.0 | 26.9 | 0.4 | 20.0 | 83% | 72% | 43% | 98% |
| 1671-12 | GmMBOAT1 | 1193-5-4-6 | 5.8 | 0.5 | 0.0 | 4.4 | 17.7 | 24.0 | 0.8 | 19.3 | 79% | 71% | 46% | 96% |
| 1671-5 | GmMBOAT1 | 1193-5-4-6 | 4.8 | 0.0 | 0.0 | 3.4 | 14.2 | 26.0 | 0.5 | 18.2 | 75% | 76% | 42% | 97% |
| 1671-10 | GmMBOAT1 | 1193-5-4-6 | 4.8 | 0.8 | 0.0 | 3.4 | 13.8 | 25.1 | 0.8 | 18.1 | 74% | 76% | 43% | 96% |
| 1671-9 | GmMBOAT1 | 1193-5-4-6 | 5.2 | 0.7 | 0.0 | 3.9 | 15.1 | 25.0 | 0.6 | 17.9 | 75% | 74% | 43% | 97% |
| 1671-11 | GmMBOAT1 | 1193-5-4-6 | 5.3 | 0.9 | 0.0 | 3.6 | 13.2 | 27.4 | 0.5 | 17.9 | 75% | 78% | 40% | 97% |

TABLE 70-continued

Fatty acid profile of T2 seed from events expressing MBOATs in
ARA/EPA-expressing event 1193-5-4-6 (EaD9Elo/EaD8Des/EaD5Des)
T2 seed for 1193 (EaD9Elo/EaD8Des/EaD5Des) background event transformed with various MBOATs

| Event | MBOAT | Background | | | | | | | | | | | | |
|---|---|---|---|---|---|---|---|---|---|---|---|---|---|---|
| 1671-8 | GmMBOAT1 | 1193-5-4-6 | 5.0 | 0.5 | 0.0 | 3.0 | 14.2 | 26.0 | 0.9 | 16.4 | 74% | 75% | 40% | 95% |
| 1671-6 | GmMBOAT1 | 1193-5-4-6 | 5.3 | 1.2 | 0.0 | 2.8 | 14.3 | 26.8 | 0.8 | 14.8 | 73% | 75% | 37% | 95% |
| 1671-3 | GmMBOAT1 | 1193-5-4-6 | 5.7 | 0.6 | 0.0 | 2.9 | 18.7 | 24.0 | 0.5 | 13.2 | 74% | 67% | 36% | 96% |
| 1671-4 | GmMBOAT1 | 1193-5-4-6 | 6.5 | 0.5 | 0.0 | 1.6 | 28.3 | 20.7 | 0.5 | 6.8 | 77% | 50% | 26% | 93% |
| | | | 4.9 | 1.1 | 0.0 | 5.0 | 12.0 | 25.7 | 0.6 | 24.0 | 79% | 81% | 49% | 97% |
| 1672-13 | GmMBOAT2 | 1193-5-4-6 | 5.2 | 0.7 | 0.0 | 3.9 | 9.8 | 27.8 | 0.9 | 20.0 | 74% | 83% | 43% | 96% |
| 1672-2 | GmMBOAT2 | 1193-5-4-6 | 5.0 | 0.6 | 0.0 | 3.6 | 12.0 | 26.9 | 0.7 | 18.7 | 72% | 79% | 42% | 97% |
| 1672-11 | GmMBOAT2 | 1193-5-4-6 | 5.8 | 0.7 | 0.0 | 3.3 | 14.3 | 27.2 | 0.9 | 17.7 | 76% | 76% | 41% | 95% |
| 1672-5 | GmMBOAT2 | 1193-5-4-6 | 5.9 | 0.5 | 0.0 | 3.2 | 14.4 | 27.7 | 1.0 | 17.5 | 77% | 76% | 40% | 95% |
| 1672-10 | GmMBOAT2 | 1193-5-4-6 | 5.8 | 0.0 | 0.0 | 3.3 | 15.5 | 26.4 | 0.8 | 16.8 | 76% | 74% | 40% | 95% |
| 1672-9 | GmMBOAT2 | 1193-5-4-6 | 5.9 | 1.0 | 0.0 | 3.5 | 12.8 | 27.1 | 0.9 | 16.8 | 73% | 78% | 39% | 95% |
| 1672-16 | GmMBOAT2 | 1193-5-4-6 | 5.3 | 0.3 | 0.0 | 3.0 | 16.1 | 26.2 | 0.7 | 15.7 | 75% | 73% | 39% | 95% |
| 1672-7 | GmMBOAT2 | 1193-5-4-6 | 6.2 | 0.5 | 0.0 | 3.2 | 15.6 | 26.7 | 0.9 | 15.5 | 75% | 73% | 38% | 95% |
| 1672-14 | GmMBOAT2 | 1193-5-4-6 | 5.8 | 0.6 | 0.0 | 3.2 | 16.4 | 25.9 | 0.6 | 15.2 | 74% | 72% | 38% | 96% |
| 1672-8 | GmMBOAT2 | 1193-5-4-6 | 5.8 | 0.6 | 0.0 | 3.3 | 16.9 | 25.6 | 0.6 | 15.1 | 75% | 71% | 38% | 96% |
| 1672-12 | GmMBOAT2 | 1193-5-4-6 | 6.0 | 0.5 | 0.0 | 3.1 | 16.0 | 26.9 | 0.6 | 14.9 | 75% | 73% | 37% | 96% |
| 1672-4 | GmMBOAT2 | 1193-5-4-6 | 5.9 | 0.5 | 0.0 | 3.0 | 17.7 | 25.7 | 0.6 | 14.3 | 75% | 70% | 37% | 96% |
| 1672-6 | GmMBOAT2 | 1193-5-4-6 | 6.2 | 0.5 | 0.0 | 3.1 | 17.3 | 25.8 | 0.7 | 14.2 | 75% | 70% | 37% | 96% |
| 1672-1 | GmMBOAT2 | 1193-5-4-6 | 6.7 | 0.8 | 0.0 | 3.0 | 16.3 | 26.0 | 0.9 | 14.1 | 74% | 72% | 37% | 94% |
| 1672-15 | GmMBOAT2 | 1193-5-4-6 | 6.4 | 0.7 | 0.0 | 2.9 | 16.7 | 26.3 | 0.8 | 13.7 | 74% | 71% | 36% | 94% |
| 1672-3 | GmMBOAT2 | 1193-5-4-6 | 5.8 | 1.1 | 0.0 | 3.0 | 14.8 | 25.4 | 0.8 | 13.5 | 71% | 73% | 36% | 94% |
| | | | 5.6 | 0.5 | 0.0 | 3.5 | 13.2 | 27.2 | 0.8 | 18.1 | 75% | 78% | 41% | 96% |
| 1673-1 | CoMBOAT | 1193-5-4-6 | 6.2 | 0.6 | 0.0 | 3.5 | 14.3 | 28.3 | 0.8 | 17.3 | 77% | 76% | 39% | 95% |
| 1673-9 | CoMBOAT | 1193-5-4-6 | 6.3 | 0.7 | 0.0 | 3.0 | 16.9 | 25.6 | 0.8 | 13.4 | 73% | 70% | 36% | 94% |
| 1673-3 | CoMBOAT | 1193-5-4-6 | 6.5 | 0.8 | 0.0 | 2.9 | 19.5 | 25.5 | 0.7 | 13.1 | 77% | 67% | 35% | 95% |
| 1673-2 | CoMBOAT | 1193-5-4-6 | 6.0 | 0.6 | 0.0 | 2.9 | 18.3 | 24.6 | 0.6 | 12.8 | 73% | 68% | 35% | 95% |
| 1673-12 | CoMBOAT | 1193-5-4-6 | 6.5 | 0.7 | 0.0 | 2.8 | 19.5 | 26.5 | 0.5 | 12.7 | 77% | 67% | 33% | 97% |
| 1673-4 | CoMBOAT | 1193-5-4-6 | 5.8 | 0.5 | 0.0 | 3.1 | 21.3 | 22.8 | 0.6 | 11.9 | 74% | 62% | 35% | 95% |
| 1673-7 | CoMBOAT | 1193-5-4-6 | 6.8 | 0.6 | 0.0 | 2.7 | 20.0 | 25.0 | 1.0 | 11.9 | 75% | 65% | 34% | 93% |
| 1673-11 | CoMBOAT | 1193-5-4-6 | 6.6 | 0.9 | 0.0 | 2.7 | 18.1 | 25.6 | 0.8 | 11.8 | 74% | 68% | 33% | 94% |
| 1673-10 | CoMBOAT | 1193-5-4-6 | 6.8 | 0.6 | 0.0 | 2.9 | 20.6 | 24.5 | 0.7 | 11.4 | 75% | 64% | 33% | 94% |
| 1673-6 | CoMBOAT | 1193-5-4-6 | 6.8 | 0.5 | 0.0 | 2.6 | 21.6 | 24.7 | 0.5 | 10.6 | 76% | 62% | 31% | 95% |
| 1673-13 | CoMBOAT | 1193-5-4-6 | 6.4 | 0.7 | 0.0 | 2.1 | 23.0 | 23.6 | 0.7 | 9.6 | 76% | 60% | 30% | 94% |
| 1673-5 | CoMBOAT | 1193-5-4-6 | 6.8 | 0.6 | 0.0 | 2.1 | 23.5 | 23.0 | 0.7 | 8.6 | 75% | 58% | 29% | 92% |
| 1673-8 | CoMBOAT | 1193-5-4-6 | 6.7 | 0.9 | 0.0 | 1.7 | 27.9 | 21.9 | 0.4 | 7.0 | 78% | 51% | 25% | 94% |
| | | | 6.3 | 0.7 | 0.0 | 3.0 | 17.7 | 26.1 | 0.7 | 13.9 | 75% | 70% | 36% | 95% |
| 1674-6 | McMBOAT | 1193-5-4-6 | 6.3 | 0.6 | 0.0 | 3.0 | 11.8 | 29.6 | 0.9 | 17.4 | 75% | 80% | 38% | 95% |
| 1674-5 | McMBOAT | 1193-5-4-6 | 6.1 | 0.6 | 0.0 | 3.7 | 14.7 | 27.0 | 0.8 | 16.6 | 75% | 75% | 39% | 96% |
| 1674-7 | McMBOAT | 1193-5-4-6 | 6.1 | 0.5 | 0.0 | 3.4 | 15.2 | 25.3 | 1.0 | 15.1 | 73% | 73% | 39% | 94% |
| 1674-10 | McMBOAT | 1193-5-4-6 | 6.8 | 0.7 | 0.5 | 3.2 | 15.9 | 26.9 | 1.5 | 15.1 | 76% | 73% | 38% | 91% |
| 1674-11 | McMBOAT | 1193-5-4-6 | 6.8 | 0.6 | 0.0 | 3.2 | 16.5 | 28.1 | 0.8 | 15.1 | 78% | 73% | 36% | 95% |
| 1674-8 | McMBOAT | 1193-5-4-6 | 7.0 | 0.8 | 0.0 | 2.9 | 16.0 | 27.3 | 1.0 | 14.4 | 75% | 73% | 36% | 94% |
| 1674-12 | McMBOAT | 1193-5-4-6 | 7.1 | 1.0 | 0.0 | 2.8 | 17.6 | 28.1 | 0.9 | 14.2 | 78% | 71% | 35% | 94% |
| 1674-3 | McMBOAT | 1193-5-4-6 | 6.5 | 0.8 | 0.0 | 3.0 | 17.8 | 26.5 | 0.6 | 13.8 | 75% | 70% | 35% | 96% |
| 1674-1 | McMBOAT | 1193-5-4-6 | 6.8 | 0.9 | 0.0 | 3.1 | 18.1 | 26.8 | 0.6 | 13.6 | 76% | 69% | 35% | 96% |
| 1674-9 | McMBOAT | 1193-5-4-6 | 6.2 | 0.0 | 0.0 | 2.7 | 22.6 | 23.4 | 0.7 | 12.3 | 76% | 62% | 36% | 95% |
| 1674-2 | McMBOAT | 1193-5-4-6 | 5.6 | 0.5 | 0.0 | 1.5 | 24.0 | 20.9 | 0.7 | 7.2 | 72% | 55% | 27% | 92% |
| 1674-4 | McMBOAT | 1193-5-4-6 | 6.3 | 0.7 | 0.0 | 1.4 | 30.0 | 19.0 | 0.5 | 5.9 | 77% | 46% | 25% | 92% |
| | | | 6.4 | 0.6 | 0.1 | 3.3 | 14.8 | 27.4 | 1.0 | 15.9 | 75% | 75% | 38% | 94% |
| 1845-11 | EuphMBOAT | 1193-5-4-6 | 6.7 | 0.0 | 0.0 | 2.4 | 20.4 | 25.4 | 0.6 | 11.5 | 75% | 65% | 32% | 95% |
| 1845-5 | EuphMBOAT | 1193-5-4-6 | 6.7 | 0.0 | 0.0 | 2.6 | 20.3 | 24.2 | 0.7 | 11.2 | 74% | 64% | 33% | 94% |
| 1845-13 | EuphMBOAT | 1193-5-4-6 | 6.2 | 0.4 | 0.0 | 2.1 | 21.9 | 23.7 | 0.6 | 9.8 | 75% | 61% | 31% | 94% |
| 1845-6 | EuphMBOAT | 1193-5-4-6 | 6.3 | 0.6 | 0.0 | 1.9 | 20.3 | 23.5 | 0.8 | 9.1 | 72% | 62% | 30% | 92% |
| 1845-3 | EuphMBOAT | 1193-5-4-6 | 6.0 | 0.0 | 0.0 | 2.0 | 23.7 | 22.3 | 0.7 | 9.0 | 75% | 57% | 30% | 93% |
| 1845-12 | EuphMBOAT | 1193-5-4-6 | 6.7 | 0.6 | 0.0 | 2.0 | 23.2 | 23.3 | 0.7 | 8.9 | 75% | 59% | 29% | 93% |
| 1845-1 | EuphMBOAT | 1193-5-4-6 | 6.6 | 0.5 | 0.0 | 2.1 | 26.0 | 22.5 | 0.4 | 8.8 | 77% | 55% | 29% | 95% |
| 1845-10 | EuphMBOAT | 1193-5-4-6 | 6.5 | 0.7 | 0.0 | 1.8 | 23.2 | 22.3 | 0.8 | 8.3 | 73% | 57% | 29% | 92% |
| 1845-2 | EuphMBOAT | 1193-5-4-6 | 6.6 | 0.7 | 0.0 | 1.9 | 23.6 | 22.6 | 0.6 | 8.2 | 74% | 57% | 28% | 93% |
| 1845-4 | EuphMBOAT | 1193-5-4-6 | 6.7 | 0.3 | 0.0 | 1.8 | 22.4 | 22.2 | 0.8 | 8.2 | 72% | 58% | 29% | 91% |
| 1845-7 | EuphMBOAT | 1193-5-4-6 | 6.1 | 0.0 | 0.0 | 1.9 | 27.5 | 21.1 | 0.5 | 8.0 | 76% | 52% | 29% | 94% |
| 1845-8 | EuphMBOAT | 1193-5-4-6 | 6.6 | 0.7 | 0.0 | 1.8 | 25.6 | 21.8 | 0.6 | 7.8 | 75% | 54% | 28% | 93% |
| 1845-9 | EuphMBOAT | 1193-5-4-6 | 6.3 | 0.5 | 0.0 | 1.8 | 28.1 | 21.2 | 0.5 | 7.6 | 77% | 51% | 28% | 94% |
| 1845-14 | EuphMBOAT | 1193-5-4-6 | 6.1 | 0.0 | 0.0 | 1.4 | 27.5 | 21.0 | 0.0 | 6.5 | 75% | 50% | 23% | 100% |
| | | | 6.4 | 0.2 | 0.0 | 2.2 | 21.3 | 23.8 | 0.7 | 10.1 | 74% | 62% | 31% | 94% |

TABLE 71

Fatty acid profile of T3 homozygous seed from events expressing MBOATs in DGLA/ETA-expressing transgenic event 1022-4-9
(EgD9Elo/TpomD8Des)
T3seed for pKR1022 (EgD9Elo/TpomD8Des) background event transformed with various MBOATs

| Event # | MBOAT | Bkgrnd | % Oil | 16:0 | 18:0 | 18:1 | 18:2 | GLA | 18:3 | STA | 20:0 | 20:1 | EDA | DGLA | ERA |
|---|---|---|---|---|---|---|---|---|---|---|---|---|---|---|---|
|  |  | 1022-4-9 |  | 7.6 | 3.0 | 16.6 | 26.2 | 0.0 | 11.1 | 0.0 | 1.2 | 14.4 | 8.9 | 5.2 | 4.4 |
| HD1-14-1 | Vect Cont | 1022-4-9 | 34.4 | 7.5 | 2.7 | 14.6 | 21.3 | 0.3 | 14.4 | 0.0 | 1.4 | 13.6 | 9.8 | 5.9 | 6.7 |
| HD1-14-7 | Vect Cont | 1022-4-9 | 34.5 | 7.4 | 2.6 | 14.1 | 20.5 | 0.1 | 14.5 | 0.0 | 1.5 | 14.6 | 10.1 | 5.9 | 7.0 |
| HD1-14-2 | Vect Cont | 1022-4-9 | 36.6 | 7.6 | 2.4 | 14.3 | 20.9 | 0.0 | 14.8 | 0.0 | 1.5 | 14.4 | 9.8 | 5.7 | 6.9 |
| Avg. |  |  | 35.2 | 7.5 | 2.6 | 14.4 | 20.9 | 0.1 | 14.6 | 0.0 | 1.5 | 14.2 | 9.9 | 5.8 | 6.8 |
| StdDev |  |  | 1.2 | 0.1 | 0.2 | 0.3 | 0.4 | 0.1 | 0.2 | 0.0 | 0.0 | 0.5 | 0.2 | 0.1 | 0.1 |
| 1671-9-7 | GmMBOAT1 | 1022-4-9 | 29.1 | 10.1 | 3.0 | 3.1 | 11.7 | 0.0 | 7.1 | 0.5 | 2.1 | 2.5 | 20.0 | 23.4 | 8.3 |
| 1671-9-5 | GmMBOAT1 | 1022-4-9 | 31.2 | 7.8 | 2.4 | 13.6 | 10.2 | 0.0 | 4.9 | 0.2 | 1.4 | 4.5 | 19.3 | 20.3 | 8.1 |
| 1671-9-1 | GmMBOAT1 | 1022-4-9 | 31.6 | 7.4 | 2.5 | 13.5 | 10.7 | 0.2 | 4.9 | 0.0 | 1.3 | 4.3 | 20.3 | 19.3 | 8.6 |
| Avg. |  |  | 30.6 | 8.4 | 2.6 | 10.1 | 10.9 | 0.1 | 5.7 | 0.2 | 1.6 | 3.7 | 19.9 | 21.0 | 8.3 |
| StdDev |  |  | 1.4 | 1.5 | 0.3 | 6.0 | 0.7 | 0.1 | 1.3 | 0.2 | 0.4 | 1.1 | 0.5 | 2.2 | 0.2 |
| 1672-15-4 | GmMBOAT2 | 1022-4-9 | 29.5 | 7.2 | 2.5 | 12.4 | 12.2 | 0.4 | 6.3 | 0.0 | 1.6 | 4.5 | 18.8 | 19.4 | 7.9 |
| 1672-15-6 | GmMBOAT2 | 1022-4-9 | 27 | 7.1 | 2.2 | 17.7 | 10.6 | 0.0 | 5.2 | 0.0 | 1.4 | 4.8 | 19.1 | 16.3 | 8.7 |
| 1672-15-1 | GmMBOAT2 | 1022-4-9 | 32.3 | 6.6 | 2.4 | 16.8 | 11.4 | 0.4 | 4.8 | 0.0 | 1.5 | 4.9 | 20.5 | 16.1 | 8.4 |
| Avg. |  |  | 29.6 | 7.0 | 2.4 | 15.6 | 11.4 | 0.2 | 5.4 | 0.0 | 1.5 | 4.8 | 19.5 | 17.3 | 8.3 |
| StdDev |  |  | 2.6 | 0.3 | 0.1 | 2.8 | 0.8 | 0.2 | 0.8 | 0.0 | 0.1 | 0.2 | 0.9 | 1.8 | 0.5 |
| 1673-10-4 | CoMBOAT | 1022-4-9 | 26.3 | 6.8 | 2.3 | 14.6 | 13.7 | 0.4 | 8.1 | 0.0 | 1.4 | 9.2 | 16.5 | 13.2 | 8.6 |
| 1673-10-1 | CoMBOAT | 1022-4-9 | 30.9 | 6.5 | 2.3 | 13.7 | 14.9 | 0.1 | 9.0 | 0.2 | 1.7 | 8.4 | 17.4 | 13.0 | 8.4 |
| 1673-10-8 | CoMBOAT | 1022-4-9 | 31.7 | 6.5 | 2.1 | 15.2 | 14.9 | 0.3 | 8.7 | 0.0 | 1.4 | 9.8 | 16.6 | 11.5 | 8.7 |
| Avg. |  |  | 29.6 | 6.6 | 2.3 | 14.5 | 14.5 | 0.3 | 8.6 | 0.1 | 1.5 | 9.1 | 16.9 | 12.6 | 8.6 |
| StdDev |  |  | 2.9 | 0.2 | 0.1 | 0.8 | 0.7 | 0.2 | 0.5 | 0.1 | 0.2 | 0.7 | 0.5 | 0.9 | 0.2 |
| 1674-4-4 | McMBOAT | 1022-4-9 | 31.8 | 6.9 | 2.6 | 13.5 | 10.7 | 0.1 | 5.5 | 0.0 | 1.7 | 4.5 | 20.3 | 18.3 | 9.8 |
| 1674-4-3 | McMBOAT | 1022-4-9 | 31.6 | 6.5 | 2.2 | 12.7 | 11.1 | 0.2 | 5.7 | 0.0 | 1.4 | 5.8 | 21.0 | 17.8 | 10.0 |
| 1674-4-6 | McMBOAT | 1022-4-9 | 32.1 | 7.8 | 2.6 | 13.6 | 13.8 | 0.0 | 7.6 | 0.3 | 1.9 | 5.8 | 17.9 | 15.5 | 8.6 |
| Avg. |  |  | 31.8 | 7.1 | 2.4 | 13.3 | 11.9 | 0.1 | 6.3 | 0.1 | 1.6 | 5.3 | 19.7 | 17.2 | 9.5 |
| StdDev |  |  | 0.3 | 0.7 | 0.2 | 0.5 | 1.7 | 0.1 | 1.1 | 0.2 | 0.2 | 0.8 | 1.6 | 1.5 | 0.7 |

| Event # | MBOAT | Bkgrnd | ETA | LA + ALA | EDA + ERA | DGLA + ETA | % D12Des | % D9Elo | % D8Des |
|---|---|---|---|---|---|---|---|---|---|
|  |  | 1022-4-9 | 1.2 | 37.3 | 13.3 | 6.3 | 77% | 35% | 32% |
| HD1-14-1 | Vect Cont | 1022-4-9 | 1.8 | 35.7 | 16.4 | 7.7 | 80% | 40% | 32% |
| HD1-14-7 | Vect Cont | 1022-4-9 | 1.8 | 34.9 | 17.1 | 7.7 | 81% | 41% | 31% |
| HD1-14-2 | Vect Cont | 1022-4-9 | 1.7 | 35.8 | 16.6 | 7.4 | 81% | 40% | 31% |
| Avg. |  |  | 1.8 | 35.5 | 16.7 | 7.6 | 81% | 41% | 31% |
| StdDev |  |  | 0.1 | 0.5 | 0.3 | 0.2 | 0% | 1% | 1% |
| 1671-9-7 | GmMBOAT1 | 1022-4-9 | 8.3 | 18.8 | 28.3 | 31.7 | 96% | 76% | 53% |
| 1671-9-5 | GmMBOAT1 | 1022-4-9 | 7.3 | 15.1 | 27.4 | 27.6 | 84% | 78% | 50% |
| 1671-9-1 | GmMBOAT1 | 1022-4-9 | 7.0 | 15.6 | 28.9 | 26.3 | 84% | 78% | 48% |
| Avg. |  |  | 7.5 | 16.5 | 28.2 | 28.5 | 88% | 77% | 50% |
| StdDev |  |  | 0.6 | 2.0 | 0.8 | 2.8 | 7% | 1% | 3% |
| 1672-15-4 | GmMBOAT2 | 1022-4-9 | 7.0 | 18.5 | 26.6 | 26.4 | 85% | 74% | 50% |
| 1672-15-6 | GmMBOAT2 | 1022-4-9 | 6.9 | 15.8 | 27.9 | 23.2 | 79% | 76% | 45% |
| 1672-15-1 | GmMBOAT2 | 1022-4-9 | 6.1 | 16.2 | 29.0 | 22.3 | 80% | 76% | 43% |
| Avg. |  |  | 6.7 | 16.8 | 27.8 | 23.9 | 81% | 76% | 46% |
| StdDev |  |  | 0.5 | 1.5 | 1.2 | 2.1 | 3% | 1% | 3% |
| 1673-10-4 | CoMBOAT | 1022-4-9 | 5.1 | 21.8 | 25.1 | 18.3 | 82% | 67% | 42% |
| 1673-10-1 | CoMBOAT | 1022-4-9 | 4.4 | 23.9 | 25.8 | 17.4 | 83% | 64% | 40% |
| 1673-10-8 | CoMBOAT | 1022-4-9 | 4.2 | 23.6 | 25.4 | 15.7 | 81% | 63% | 38% |
| Avg. |  |  | 4.6 | 23.1 | 25.4 | 17.1 | 82% | 65% | 40% |
| StdDev |  |  | 0.5 | 1.1 | 0.4 | 1.3 | 1% | 2% | 2% |
| 1674-4-4 | McMBOAT | 1022-4-9 | 6.0 | 16.2 | 30.1 | 24.4 | 84% | 77% | 45% |
| 1674-4-3 | McMBOAT | 1022-4-9 | 5.7 | 16.8 | 31.0 | 23.5 | 85% | 76% | 43% |
| 1674-4-6 | McMBOAT | 1022-4-9 | 4.6 | 21.4 | 26.5 | 20.1 | 83% | 69% | 43% |
| Avg. |  |  | 5.5 | 18.1 | 29.2 | 22.7 | 84% | 74% | 44% |
| StdDev |  |  | 0.8 | 2.8 | 2.4 | 2.3 | 1% | 5% | 1% |

A summary of the average fatty acid conversion efficiencies for the five events having highest DGLA+ETA content in T2 seed from events expressing MBOATs in DGLA/ETA-expressing transgenic event 1559-17-11(MaD6des/MaD6Elo) is shown in TABLE 72. Conversion efficiencies were calculated as described above. Also shown in TABLE 72 is the relative % conversion for each step of the pathway where the Average % Conversion for the Top5 events of each experiment is divided by the Average % Conversion for the Top5 events of the control seed expressing pHD1.

TABLE 72

Comparing average conversion efficiencies for each step of a delta-6 desaturase pathway from *Arabidopsis* T2 seed expressing MBOATs in a DGLA/ETA-expressing transgenic event 1559-17-11
Top5 Avg. for T2 seed of pKR1559 (MaD6Des, MaElo) background event transformed with various MBOATs

| MBOAT | Bkgrnd | Top5 Avg. % D12Des | Top5 Avg. % D6Des | Top5 Avg. % D9Elo | Rel. % D12Des | Rel. % D6Des | Rel. % D6Elo |
|---|---|---|---|---|---|---|---|
| — | 1559-17-11 | 76% | 18% | 31% | 1.00 | 1.00 | 1.00 |
| GmMBOAT1 | 1559-17-11 | 80% | 15% | 77% | 1.05 | 0.83 | 2.45 |
| GmMBOAT2 | 1559-17-11 | 81% | 21% | 76% | 1.06 | 1.13 | 2.42 |
| CoMBOAT | 1559-17-11 | 74% | 15% | 81% | 0.97 | 0.84 | 2.58 |
| McMBOAT | 1559-17-11 | 80% | 22% | 61% | 1.06 | 1.20 | 1.93 |
| EuphMBOAT | 1559-17-11-8 | 78% | 26% | 49% | 1.03 | 1.45 | 1.57 |

A summary of the average fatty acid conversion efficiencies for the five events having highest EDA/ERA content in T2 seed from events expressing MBOATs in EDA/ERA-expressing transgenic event 926-5-4-1 (EgD9Elo) is shown in TABLE 73. Conversion efficiencies were calculated as described above. Also shown in TABLE 73 is the relative % conversion for each step of the pathway where the Average % Conversion for the Top5 events of each experiment is divided by the Average % Conversion for the Top5 events of the control seed expressing pHD1.

TABLE 73

Comparing average conversion efficiencies for each step of a delta-9 elongase pathway from *Arabidopsis* T2 seed expressing MBOATs in EDA/ERA-expressing transgenic event 926-5-4-1 (EgD9Elo)
Top5 Avg. for pKR926 (EgD9Elo) background event transformed with various MBOATs

| MBOAT | Bkgrnd | Top5 Avg. % D12Des | Top5 Avg. % D9Elo | Rel. % D12Des | Rel. % D9Elo |
|---|---|---|---|---|---|
| — |  | 80% | 42% | 1.00 | 1.00 |
| GmMBOAT1 | 926-5-4-1 |  |  |  |  |
| GmMBOAT2 | 926-5-4-1 | 83% | 55% | 1.03 | 1.34 |
| CoMBOAT | 926-5-4-1 | 84% | 37% | 1.05 | 0.90 |
| McMBOAT | 926-5-4-1 | 83% | 55% | 1.04 | 1.33 |
| EuphMBOAT | 926-5-4-1 | 82% | 47% | 1.02 | 1.12 |

A summary of the average fatty acid conversion efficiencies for the five events having highest EDA/ERA content in T2 seed from events expressing MBOATs in EDA/ERA-expressing transgenic event 1191-4-11 (EaD9Elo) is shown in TABLE 74. Conversion efficiencies were calculated as described above. Also shown in TABLE 74 is the relative % conversion for each step of the pathway where the Average % Conversion for the Top5 events of each experiment is divided by the Average % Conversion for the Top5 events of the control seed expressing pHD1.

TABLE 74

Comparing average conversion efficiencies for each step of a delta-9
elongase pathway from *Arabidopsis* T2 seed expressing
MBOATs in EDA/ERA-expressing transgenic event 1191-4-11 (EaD9Elo)
Top5 Avg. for pKR1191(EaD9Elo) background
event transformed with various MBOATs

| MBOAT | Bkgrnd | Top5 Avg. % D12Des | Top5 Avg. % D9Elo | Rel. % D12Des | Rel. % D9Elo |
|---|---|---|---|---|---|
| — | | 86% | 52% | 1.00 | 1.00 |
| GmMBOAT1 | 1191-4-11 | | | | |
| GmMBOAT2 | 1191-4-11 | | | | |
| CoMBOAT | 1191-4-11 | 87% | 61% | 1.01 | 1.18 |
| McMBOAT | 1191-4-11 | 88% | 73% | 1.03 | 1.40 |
| EuphMBOAT | 1191-4-11 | | | | |

A summary of the average fatty acid conversion efficiencies for the five events having highest DGLA/ETA content in T2 seed from events expressing MBOATs in DGLA/ETA-expressing transgenic event 1022-4-9 (EgD9Elo/TpomD8Des) is shown in TABLE 75. Conversion efficiencies were calculated as described above. Also shown in TABLE 75 is the relative % conversion for each step of the pathway where the Average % Conversion for the Top5 events of each experiment is divided by the Average % Conversion for the Top5 events of the control seed expressing pHD1

TABLE 75

Comparing average conversion efficiencies for each step of a delta-9 elongase
pathway from *Arabidopsis* T2 seed expressing MBOATs in DGLA/ETA-expressing
transgenic event 1022-4-9 (EgD9Elo/TpomD8Des)
Top5 Avg. for T2 seed of pKR1022 (EgD9Elo/TpomD8Des)
background event transformed with various MBOATs

| MBOAT | Bkgrnd | Top5 Avg. % D12Des | Top5 Avg. % D9Elo | Top5 Avg. % D8Des | Rel. % D12Des | Rel. % D9Elo | Rel. % D8Des |
|---|---|---|---|---|---|---|---|
| — | 1022-4-9 | 80% | 45% | 31% | 1.00 | 1.00 | 1.00 |
| GmMBOAT1 | 1022-4-9 | 82% | 72% | 49% | 1.03 | 1.61 | 1.57 |
| GmMBOAT2 | 1022-4-9 | 83% | 73% | 49% | 1.04 | 1.64 | 1.58 |
| CoMBOAT | 1022-4-9 | 84% | 64% | 41% | 1.05 | 1.42 | 1.31 |
| McMBOAT | 1022-4-9 | 85% | 70% | 41% | 1.06 | 1.57 | 1.31 |
| EuphMBOAT | 1022-4-9 | 78% | 58% | 38% | 0.97 | 1.29 | 1.23 |

A summary of the average fatty acid conversion efficiencies for the five events having highest DGLA/ETA content in T2 seed from events expressing MBOATs in DGLA/ETA-expressing transgenic event 1192-1-2 (EaD9Elo/EaD8Des) is shown in TABLE 76. Conversion efficiencies were calculated as described above. Also shown in TABLE 76 is the relative % conversion for each step of the pathway where the Average % Conversion for the Top5 events of each experiment is divided by the Average % Conversion for the Top5 events of the control seed expressing pHD1.

TABLE 76

Comparing average conversion efficiencies for each step of a delta-9 elongase
pathway from *Arabidopsis* T2 seed expressing MBOATs in DGLA/ETA-expressing
transgenic event 1192-1-2 (EaD9Elo/EaD8Des)
Top5 Avg. for T2 seed of 1192 (EaD9Elo/EaD8Des)
background event transformed with various MBOATs

| MBOAT | Bkgrnd | Top5 Avg. % D12Des | Top5 Avg. % D9Elo | Top5 Avg. % D8Des | Rel. % D12Des | Rel. % D9Elo | Rel. % D8Des |
|---|---|---|---|---|---|---|---|
| — | 1192-1-2 | 72% | 54% | 44% | 1.00 | 1.00 | 1.00 |
| GmMBOAT1 | 1192-1-2 | 78% | 80% | 51% | 1.08 | 1.48 | 1.17 |
| GmMBOAT2 | 1192-1-2 | 75% | 78% | 46% | 1.03 | 1.45 | 1.05 |
| CoMBOAT | 1192-1-2 | 76% | 69% | 47% | 1.04 | 1.29 | 1.08 |
| McMBOAT | 1192-1-2 | 78% | 74% | 47% | 1.08 | 1.37 | 1.07 |
| EuphMBOAT | 1192-1-2 | 72% | 63% | 35% | 1.00 | 1.18 | 0.80 |

A summary of the average fatty acid conversion efficiencies for the five events having highest DGLA/ETA content in T2 seed from events expressing MBOATs in DGLA/ETA-expressing transgenic event 1203-13-1-5 (EgD9Elo-EaD8Des fusion) is shown in TABLE 77. Conversion efficiencies were calculated as described above. Also shown in TABLE 77 is the relative % conversion for each step of the pathway where the Average % Conversion for the Top5 events of each experiment is divided by the Average % Conversion for the Top5 events of the control seed expressing pHD1.

TABLE 77

Comparing average conversion efficiencies for each step of a delta-9 elongase pathway from *Arabidopsis* T2 seed expressing MBOATs in DGLA/ETA-expressing transgenic event 1203-13-1-5 (EgD9Elo-EaD8Des fusion)
Top5 Avg. for T2 seed of 1203 (EgD9Elo-EaD8Des fusion) background event transformed with various MBOATs

| MBOAT | Bkgrnd | Top5 Avg. % D12Des | Top5 Avg. % D9Elo | Top5 Avg. % D8Des | Rel. % D12Des | Rel. % D9Elo | Rel. % D8Des |
|---|---|---|---|---|---|---|---|
| — | 1203-13-1-5 | 68% | 46% | 34% | 1.00 | 1.00 | 1.00 |
| GmMBOAT1 | 1203-13-1-5 | 71% | 64% | 47% | 1.05 | 1.38 | 1.37 |
| GmMBOAT2 | 1203-13-1-5 | 71% | 62% | 46% | 1.05 | 1.35 | 1.35 |
| CoMBOAT | 1203-13-1-5 | 69% | 58% | 37% | 1.02 | 1.25 | 1.09 |
| McMBOAT | 1203-13-1-5 | 73% | 64% | 43% | 1.08 | 1.39 | 1.25 |
| EuphMBOAT | 1203-13-1-5 | 73% | 55% | 38% | 1.08 | 1.19 | 1.11 |

A summary of the average fatty acid conversion efficiencies for the five events having highest ARA/EPA content in T2 seed from events expressing MBOATs in ARA/EPA-expressing event 1193-5-4-6 (EaD9Elo/EaD8Des/EaD5Des) is shown in TABLE 78. Conversion efficiencies were calculated as described above. Also shown in TABLE 78 is the relative % conversion for each step of the pathway where the Average % Conversion for the Top5 events of each experiment is divided by the Average % Conversion for the Top5 events of the control seed expressing pHD1.

TABLE 78

Comparing average conversion efficiencies for each step of a delta-9 elongase pathway from *Arabidopsis* T2 seed expressing MBOATs in ARA/EPA-expressing event 1193-5-4-6 (EaD9Elo/EaD8Des/EaD5Des)
Top5 Avg. for T2 seed of 1193 (EaD9Elo/EaD8Des/EaD5Des) background event transformed with various MBOATs

| MBOAT | Bkgrnd | Top5 Avg. % D12Des | Top5 Avg. % D9Elo | Top5 Avg. % D8Des | Top5 Avg. % D5Des | Rel. % D12Des | Rel. % D9Elo | Rel. % D8Des | Rel. % D5Des |
|---|---|---|---|---|---|---|---|---|---|
| — | 1193-5-4-6 | 77% | 56% | 31% | 95% | 1.00 | 1.00 | 1.00 | 1.00 |
| GmMBOAT1 | 1193-5-4-6 | 79% | 81% | 49% | 97% | 1.03 | 1.45 | 1.59 | 1.02 |
| GmMBOAT2 | 1193-5-4-6 | 75% | 78% | 41% | 96% | 0.98 | 1.40 | 1.33 | 1.01 |
| CoMBOAT | 1193-5-4-6 | 75% | 70% | 36% | 95% | 0.98 | 1.25 | 1.16 | 1.00 |
| McMBOAT | 1193-5-4-6 | 75% | 75% | 38% | 94% | 0.98 | 1.34 | 1.24 | 0.99 |
| EuphMBOAT | 1193-5-4-6 | 74% | 62% | 31% | 94% | 0.97 | 1.11 | 1.01 | 0.99 |

A summary of the average fatty acid conversion efficiencies for 3 homozygous T3 seed pools from events expressing MBOATs in DGLA/ETA-expressing transgenic event 1022-4-9 (EgD9Elo/TpomD8Des) is shown in TABLE 79. Conversion efficiencies were calculated as described above. Also shown in TABLE 79 is the relative % conversion for each step of the pathway where the Average % Conversion for the Top5 events of each experiment is divided by the Average % Conversion for the Top5 events of the control seed expressing pHD1.

TABLE 79

Comparing average conversion efficiencies for each step of a delta-9 elongase pathway from *Arabidopsis* homozygous T3 seed expressing MBOATs in DGLA/ETA-expressing transgenic event 1022-4-9 (EgD9Elo/TpomD8Des) Avg. for homozyous T3 seed of pKR1022 (EgD9Elo/TpomD8Des) background event transformed with various MBOATs

| MBOAT | Bkgrnd | Top5 Avg. % D12Des | Top5 Avg. % D9Elo | Top5 Avg. % D8Des | Top5 Avg. % D5Des | Rel. % D12Des | Rel. % D9Elo | Rel. % D8Des | Rel. % D5Des |
|---|---|---|---|---|---|---|---|---|---|
| — | 1022-4-9 | 81% | 41% | 31% | 95% | 1.00 | 1.00 | 1.00 | 1.00 |
| GmMBOAT1 | 1022-4-9 | 88% | 77% | 50% | 97% | 1.09 | 1.91 | 1.61 | 1.02 |
| GmMBOAT2 | 1022-4-9 | 81% | 76% | 46% | 96% | 1.01 | 1.86 | 1.48 | 1.01 |
| CoMBOAT | 1022-4-9 | 82% | 65% | 40% | 95% | 1.02 | 1.59 | 1.29 | 1.00 |
| McMBOAT | 1022-4-9 | 84% | 74% | 44% | 94% | 1.04 | 1.82 | 1.40 | 0.99 |

SEQUENCE LISTING (158 sequences)

SEQ ID NO: 1 - DNA, 1634 bp, Calendula officinalis
gcaccagctcacgtgtgagacataaagctgaaaaggtatggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtccatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatgagaaaaaaatcatctcgtgagaaatccgtttgtagaattgttcacttgatagcatatttaaaacttataataagtgatttgtacaacattggaattactaaagacgggattttattaaatattccgaccaatcagactgttttagattgaaaaaaaaaaaaaaaaaaaaaaaaaaaaaaaaaaaaaaaaaaaaaaaaaaaaaaaaaaaa

SEQ ID NO: 2 - DNA, 1389 bp, Calendula officinalis
atggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtccatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatga

SEQ ID NO: 3 - protein, 462 aa, Calendula officinalis
MDMESTATAIGVSVPVLRFLLCFVATIPAGFFHRLIPGGPTGKHLYAASTGVVLSYLSFGFSSNLHFLVPMLVSYVSMVVYRKRCGLITFVLAMGYLIGCHVYYMSGDAWKEGGIDATGALMVITLKVISCAINYNDGLLKDEDLRESQKKNQLLKLPSLIEYVGFCLCCGSHFAGPVYEIKDYLDWTEGKGIWIKSEKGSPSPFGPTVKALVQAGVCMGLYLYLVPHYPLSKFTDPIYKEWGFWKRLSYQYMAGFTARWKYYFIWSISEASIVISGLGFSGWADSSPPKARWDRAKNVDVLGVEFARSAVEIPLVWNIQVSTWLRHYVYDRLVKKGKKAGFFQLLATQTVSAVWHGLYPGYIIFFVQSALMIAGSRAIYRWQQSVPPNLGLLKKIFMLVNFAYTLLVLNYSCVGFMVLSLHETVTAYGSVYYIGTIIPVVLILLGNVIKTKPVRSKARKDQ

SEQ ID NO: 4 - protein, 463 aa, Vitis vinifera
MDFDMESMASAIGVSVPVLRFLLCFVATIPVSFLVRFIPGAFTRHVYSAFTGASLSYLSFGFSSNLHFLVPMLLGYAAMLLCRRRCGVITFFLGFGYLIGCHVYYMSGDAWKEGGIDATGALMVLTLKVISCAMNYNDGLLKEDGLREAQKKNRLLKLPSLIEYFGYCLCCGSHFAGPVYEIKDYLEWTERKGIWAKSEKGPPPSPYGATIRALIQAAFCMGLYVYLVPHFPLTIFTDPVYQEWGFWKRLGYQYMCGFTARWKYYFIWSISEAAVIISGLGFSGWTESSPPKPKWDRAKNVDILGVELAKSAVTLPLVWNIQVSTWLRYYVYERLIQNGKKPGFLQLLATQTVSAVWHGLYPGYIIFFVQSALMIAGSRVLYRWQQATSNALFKKMVVFINFAYTLLVLNYSCVGFMVLSLHETLASYGSVYYIGTILPIVLVLLGYIIKPAKPVRSKARKEQ

SEQ ID NO: 5 - protein, 462 aa, Arabidopsis thaliana
MDMSSMAGSIGVSVAVLRFLLCFVATIPVSFACRIVPSRLGKHLYAAASGAFLSYLSFGFSSNLHFLVPMTIGYASMAIYRPKCGIITFFLGFAYLIGCHVFYMSGDAWKEGGIDSTGALMVLTLKVISCSMNYNDGMLKEEGLREAQKKNRLIQMPSLIEYFGYCLCCGSHFAGPVYEMKDYLEWTEGKGIWDTTEKRKKPSPYGATIRAILQAAICMALYLYLVPQYPLTRFTEPVYQEWGFLRKFSYQYMAGFTARWKYYFIWSISEASIIISGLGFSGWTDDASPKPKWDRAKNVDILGVELAKSAVQIPLVWNIQVSTWLRHYVYERLVQNGKKAGFFQLLATQTVSAVWHGLYPGYMMFFVQSALMIAGSRVIYRWQQAISPKMAMLRNIMVFINFLYTVLVLNYSAVGFMVLSLHETLTAYGSVYYIGTIIPVGLILLSYVVPAKPSRPKPRKEE

SEQ ID NO: 6 - DNA, 1284 bp, Momordica charantia
atctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtgaggtaagaaagtgcagtcatctttgtggggggtttctgaataactttaaacgagtgagtaaaggagaagaagccagtggcttctttttccacttgagatgctgaagattgatcgctaaattgttatttattttagttgattgatggatcttttgggttaaaaaaaaaaaaaaaaaa

SEQ ID NO: 7 - DNA, 20 bp, Artificial Sequence
  primer
ccatacaaaaggcagcttgg

SEQ ID NO: 8 - DNA, 33 bp, Artificial Sequence
  primer
attgcacatgaaatgactttcagtgtcaatacc

SEQ ID NO: 9 - DNA, 523 bp, Momordica charantia
atggcaggaggaggagaaggcccagtgtagatctcagcggagcttcgttaacttcgagagaagagaatcagtgcatctcctagaaggcagagcagattcaagctccgcaaaaatccgcttccatgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaat

SEQ ID NO: 10 - DNA, 1695 bp, Momordica charantia
atggcaggaggaggagaaggcccagtgtagatctcagcggagcttcgttaacttcgagagaagagaatcagtgcatctcctagaaggcagagcagattcaagctccgcaaaaatccgcttccatgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtgaggtaagaaagtgcagtcatctttgtggggggtttctgaataactttaaacgagtgagtaaaggagaagaagccagtggcttctttttccacttgagatgctgaagattgatcgctaaattgttatttattttagttgattgatggatcttttgggttaaaaaaaaaaaaaaaaaa

SEQ ID NO: 11 - DNA, 1398 bp, Momordica charantia
atgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtga

SEQ ID NO: 12 - protein, 465 aa, Momordica charantia
MGLEMEPLAASIGISVPVLRFLLCFVATIPVSFLWRLVPGRLPKHLYSALSGVLLSYLSFGFSSNLHFLVPMSLGYASMLLFHRHCGFITFFLGFGYLIGCHVYYMSGDAWKEGGIDATGALMVLTLKVISCAINYNDGLLKEEGLSEAQKKNRLIKLPSSIEYIGYCLCCGSHFAGPVYEMKDYLEWTEGNGIWKHDEQNPSPSPYFATIRALFQAAFCMGLYLYLVPQFPLSRFIDPVYLEWPFWKRLGYQYMAGFTARWKYYFIWSISEAAIIISGLGFSGWTKSSPPKPSWDRAINVDIIGLELVKSAVEIPLKWNIQVSTWLRHYVYERLVQKGKRPGFFQLLATQTVSAVWHGLYPGYIIFFVQSALMIAGSRVIYRWQVAVPPTLAFLKIILGFFNFAYTVLVLNYSCVGFMVLSLHETLASYGSVYYIGTVIPVTLILLGSIIKPARPVRSKARKEE

SEQ ID NO: 13 - DNA, 1344 bp, Calendula officinalis
gattcttgcaaggttttctaagctctattattgcaggttgacaactctccaaggtcttgggactgttaaccgaccgtttttgtcatgtcgaagacggaggagacaaatggattaatcctgccaccaccaccagcagcagcagaaccaccaacaccggcgttgttcacaagtaaaatcatttcaccaattcatacatatgttgcacttttagtgtggctcggtgctgttcattttatcggaattattaatgtcaccaccttcttattgctcccctttcacaaatacctcctggtagtgggaatatttgtggtcttgatgttcatccccattaatgaggacagtaaatggggcttagctttagccaggtacatatataagcatgggggtggtcatttccctgcttctgtatatgttgaagatattaaagcattcaatcctgatcagacttacgtttttggatacgaaccccattcggtttgtccatttggagctggggcaatatcacatttcaccggttttttgcctacaggcaaagtcaagatccttgcaagtaccgctgtgttcttaacgccgttcatgaggcatatatggacatggatgggagtgtcaccggcaacaagggaaaacttcaagtctcttttaaaaaacggttatagttgcgtagttgtcccaggtggagtacgtgaggtcttttacatggagcctaattcagaggttgcctttttaaaagcaagaaaagggttcatacgtctcgcaatggagactggttctcccttggtccctgttttcgcctttgggcagtcagctgcttaccagtattggaggccaaagggggaactttatctgaaactgacccgagctgtcaagttcacgcctatatttttcgggggtaaattttggtctcctataccgtttcgacgacctgttcttgtggtggtcggtaagccaatacaagtgaagaagagttctactcccactatggaagaggttaatgaagtacatgatgagtttgtgaaagcacttaaagagttatttgatacgcataaagcacgagcaggatatcctgatatggagttacgtgtgatgtgatcagattgcggattaaccaattcaagtttgactcaggattagtcaacggtggcagatttcttagatgtttagtgaagaaataaaatttgtggaaatgggatggattccaattaattgcttatgttctacatattggatttgaaattgttacttgacttttggaccatccgatttagcaaaatgcttaatgcaacaggctttattagtaaaaaaaaaaaaaaaaaaaaaaaaaaaaaaaaaaaaaaaaaaaaaaaa

SEQ ID NO: 14 - DNA, 1005 bp, Calendula officinalis
atgtcgaagacggaggagacaaatggattaatcctgccaccaccaccagcagcagcagaaccaccaacaccggcgttgttcacaagtaaaatcatttcaccaattcatacatatgttgcacttttagtgtggctcggtgctgttcattttatcggaattattaatgtcaccaccttcttattgctcccctttcacaaatacctcctggtagtgggaatatttgtggtcttgatgttcatccccattaatgaggacagtaaatggggcttagctttagccaggtacatatataagcatgggggtggtcatttccctgcttctgtatatgttgaagatattaaagcattcaatcctgatcagacttacgtttttggatacgaaccccattcggtttgtccatttggagctggggcaatatcacatttcaccggttttttgcctacaggcaaagtcaagatccttgcaagtaccgctgtgttcttaacgccgttcatgaggcatatatggacatggatgggagtgtcaccggcaacaagggaaaacttcaagtctcttttaaaaaacggttatagttgcgtagttgtcccaggtggagtacgtgaggtcttttacatggagcctaattcagaggttgcctttttaaaagcaagaaaagggttcatacgtctcgcaatggagactggttctcccttggtccctgttttcgcctttgggcagtcagctgcttaccagtattggaggccaaagggggaactttatctgaaactgacccgagctgtcaagttcacgcctatatttttcgggggtaaattttggtctcctataccgtttcgacgacctgttcttgtggtggtcggtaagccaatacaagtgaagaagagttctactcccactatggaagaggttaatgaagtacatgatgagtttgtgaaagcacttaaagagttatttgatacgcataaagcacgagcaggatatcctgatatggagttacgtgtgatgtga

SEQ ID NO: 15 - protein, 334 aa, Calendula officinalis
MSKTEETNGLILPPPPAAAEPPTPALFTSKIISPIHTYVALLVWLGAVHFIGIINVTTFLLLPFHKYLLVVGIFVVLMFIPINEDSKWGLALARYIYKHGGGHFPASVYVEDIKAFNPDQTYVFGYEPHSVCPFGAGAISHFTGFLPTGKVKILASTAVFLTPFMRHIWTWMGVSPATRENFKSLLKNGYSCVVVPGGVREVFYMEPNSEVAFLKARKGFIRLAMETGSPLVPVFAFGQSAAYQYWRPKGELYLKLTRAVKFTPIFFGGKFWSPIPFRRPVLVVVGKPIQVKKSSTPTMEEVNEVHDEFVKALKELFDTHKARAGYPDMELRVM

SEQ ID NO: 16 - protein, 337 aa, Vitis vinifera
MSGKMGKGMEERKEQWGSSGSVEETLTVFQGREDDSLIHSIAALTIWLGAIHFVVALVLTALLFLPLSLALTVFGLLLVFMVIPIDERSKYGRKLSRYICKHACGYFPVTLYVEDIKAFDPNRAYVFGYEPHSVLPIGVVALADLTGFLPLSKIKVLASSAVFYVPFLRHIWTWLGLTPATKKNFTSLLASGYSCIIVPGGVQEPCLMEHGCEVAFLKSRKGFVRIAMEMGRPLVPVFCFGQSRVYKWWKPGGNLYLQFSRAIKFTPIFFWGIFGSPLPYRHPMDVVVGRPIEVKKNVQPTVEEVIEVHGQFVEALNDLFEKHKARVGHADLQLKIL

SEQ ID NO: 17 - protein, 327 aa, Elaeis oleifera
GDRQPAVFDDSAGAGEAAVYRGTEYSVVRTTVALALWLGLIHFNVALVLTALLLLPARLAAAVFALLLVFMAIPLDENSKWGRKLSRWICKYAVGYFPVTLYVEDIKVFDPNQAYVFAFEPHSVLPIGVVALADLTGFMPLTKVKVLASSAVFYTPFLRHLWTWLGLVSASRKNFYAYLEAGYSCIVVPGGVQEMLHMDHDSEVAFLKARKGFVRIAMETGRPIVPVFCFGQSYVYKWWKPSGKLFVWIARAIKFTPIVFWGRFGSPIPFQHPMQVVVGKPIGLKRNPKPTIEEINEVHAQFVAAFQELFEKHKTRAGYPDFRLRVL

SEQ ID NO: 18 - DNA, 1275 bp, Momordica charantia
ctccaatcctcgagtgggatggtgccgtcggtcacagttttcaagggagatgggtcgcccaccaaatgccggatgatgcacttgcacgtaatcgcagccttgtgtatttggctcggcgccattcatctcaattttgctctaggcctcatctccctcttctacctctccctccccaaagccctctcgtcagttttgcttctctctttcccttttctttcccctttttgccgcgtctttccttcaactttctttttgccttttcctttcagggtcggcgccttacttttcatattagtgctaattcctgtcaacgacaaagccaaatacggtcgcttattggccaggtctgttctgcttctgcttcctcctttttttctctttcatctccccctcaccatttgcccttcgctcccaggtatatatgtaaaagcgctaccgcctattttcctattactctacatgtccaagatatacatgcctttgatcccaatcgtgcttatgttcttggttatgagccacattcggttttacctattggtgttgttgcattgagcgaccttactggtttcatgcctctccaaaaaataaaagtccttgctagttccgctgtgttttatacaccgtttttgaggcacatatggacatggatgggtctaacgccagcaacaaagaaaaatttcatctccctcttggcagctggctatagttgtatcattgtgcctggtggagtacaagagacatttcatatggagcataattcggagactgtcttcctcaagacaagacgaggatttgttcgcttagcgatggagatgggcacacccctggtcccagttttctgctttggtcagtcgagcgtctatcattggtggaagcctggtgggaagttgttcctccaattttctagagcgatcaagttcactccaattgtcttctggggagttttcggatctccccttccctttaggcggcggatgcatgtggtggtggggagacccattgaggtgaagaaaaatccaaacccaacgagtgatgaggttcttgatgtacatggtcagtttgttgaagcactccaggatatatttgaaaggtacaaagcacagcttggctatgataatctgcagctgaaagttctttgattaacatgttaattggctccagcgtttaatcctctgctcactttttgtattcaagatctgcagcaattaaaaaaaatgcccttcattctaaaaaaaaaaaaaaaaaaaaaaaaaaaaaaaaaaaaaaaaaaaaaaa

SEQ ID NO: 19 - DNA, 21 bp, Artificial Sequence
  primer
tttggctttgtcgttgacagg

SEQ ID NO: 20 - DNA, 345 bp, Momordica charantia
tccgaagcctaccctcagctaaagggaacaaaagctggagctccaccgcggtggcggccgctctagaactagtggatcccccgggctgcaggaattcggcacgagctccaatcctcgagtgggatggtgccgtcggtcacagttttcaagggagatgggtcgcccaccaaatgccggatgatgcacttgcacgtaatcgcagccttgtgtatttggctcggcgccattcatctcaattttgctctaggcctcatctccctcttctacctctccctccccaaagccctctcggtcggcgccttacttttcatattagtgctaattcctgtcaacgacaaagccaaa

SEQ ID NO: 21 - DNA, 40 bp, Artificial Sequence
  primer
agcggccgcaccatggtgccgtcggtcacagttttcaagg

SEQ ID NO: 22 - DNA, 41 bp, Artificial Sequence
  primer
agcggccgctcaaagaactttcagctgcagattatcatagc

SEQ ID NO: 23 - DNA, 987 bp, Artificial Sequence
  gene sequence with flanking restriciton enzyme sites
agcggccgcaccatggtgccgtcggtcacagttttcaagggagatgggtcgcccaccaaatgccggatgatgcacttgcacgtaatcgcagccttgtgtatttggctcggcgccattcatctcaattttgctctaggcctcatctccctcttctacctctccctccccaaagccctctcggtcggcgccttacttttcatattagtgctaattcctgtcaacgacaaagccaaatacggtcgcttattggccaggtatatatgtaaaagcgctaccgcctattttcctattactctacatgtccaagatatacatgcctttgatcccaatcgtgcttatgttcttggttatgagccacattcggttttacctattggtgttgttgcattgagcgaccttactggtttcatgcctctccaaaaaataaaagtccttgctagttccgctgtgttttatacaccgtttttgaggcacatatggacatggatgggtctaacgccagcaacaaagaaaaatttcatctccctcttggcagctggctatagttgtatcattgtgcctggtggagtacaagagacatttcatatggagcataattcggagactgtcttcctcaagacaagacgaggatttgttcgcttagcgatggagatgggcacacccctggtcccagttttctgctttggtcagtcgagcgtctatcattggtggaagcctggtgggaagttgttcctccaattttctagagcgatcaagttcactccaattgtcttctggggagttttcggatctccccttccctttaggcggcggatgcatgtggtggtggggagacccattgaggtgaagaaaaatccaaacccaacgagtgatgaggttcttgatgtacacggtcagtttgttgaagcactccaggatatatttgaaaggtacaaagcacagcttggctatgataatctgcagctgaaagttctttgagcggccgct

SEQ ID NO: 24 - DNA, 1089 bp, Momordica charantia
tccgaagcctaccctcagctaaagggaacaaaagctggagctccaccgcggtggcggccgctctagaactagtggatcccccgggctgcaggaattcggcacgagctccaatcctcgagtgggatggtgccgtcggtcacagttttcaagggagatgggtcgcccaccaaatgccggatgatgcacttgcacgtaatcgcagccttgtgtatttggctcggcgccattcatctcaattttgctctaggcctcatctccctcttctacctctccctccccaaagccctctcggtcggcgccttacttttcatattagtgctaattcctgtcaacgacaaagccaaatacggtcgcttattggccaggtatatatgtaaaagcgctaccgcctattttcctattactctacatgtccaagatatacatgcctttgatcccaatcgtgcttatgttcttggttatgagccacattcggttttacctattggtgttgttgcattgagcgaccttactggtttcatgcctctccaaaaaataaaagtccttgctagttccgctgtgttttatacaccgtttttgaggcacatatggacatggatgggtctaacgccagcaacaaagaaaaatttcatctccctcttggcagctggctatagttgtatcattgtgcctggtggagtacaagagacatttcatatggagcataattcggagactgtcttcctcaagacaagacgaggatttgttcgcttagcgatggagatgggcacacccctggtcccagttttctgctttggtcagtcgagcgtctatcattggtggaagcctggtgggaagttgttcctccaattttctagagcgatcaagttcactccaattgtcttctggggagttttcggatctccccttccctttaggcggcggatgcatgtggtggtggggagacccattgaggtgaagaaaaatccaaacccaacgagtgatgaggttcttgatgtacacggtcagtttgttgaagcactccaggatatatttgaaaggtacaaagcacagcttggctatgataatctgcagctgaaagttctttga

SEQ ID NO: 25 - DNA, 966 bp, Momordica charantia
atggtgccgtcggtcacagttttcaagggagatgggtcgcccaccaaatgccggatgatgcacttgcacgtaatcgcagccttgtgtatttggctcggcgccattcatctcaattttgctctaggcctcatctccctcttctacctctccctccccaaagccctctcggtcggcgccttacttttcatattagtgctaattcctgtcaacgacaaagccaaatacggtcgcttattggccaggtatatatgtaaaagcgctaccgcctattttcctattactctacatgtccaagatatacatgcctttgatcccaatcgtgcttatgttcttggttatgagccacattcggttttacctattggtgttgttgcattgagcgaccttactggtttcatgcctctccaaaaaataaaagtccttgctagttccgctgtgttttatacaccgtttttgaggcacatatggacatggatgggtctaacgccagcaacaaagaaaaatttcatctccctcttggcagctggctatagttgtatcattgtgcctggtggagtacaagagacatttcatatggagcataattcggagactgtcttcctcaagacaagacgaggatttgttcgcttagcgatggagatgggcacacccctggtcccagttttctgctttggtcagtcgagcgtctatcattggtggaagcctggtgggaagttgttcctccaattttctagagcgatcaagttcactccaattgtcttctggggagttttcggatctccccttccctttaggcggcggatgcatgtggtggtggggagacccattgaggtgaagaaaaatccaaacccaacgagtgatgaggttcttgatgtacacggtcagtttgttgaagcactccaggatatatttgaaaggtacaaagcacagcttggctatgataatctgcagctgaaagttctttga

SEQ ID NO: 26 - protein, 321 aa, Momordica charantia
MVPSVTVFKGDGSPTKCRMMHLHVIAALCIWLGAIHLNFALGLISLFYLSLPKALSVGALLFILVLIPVNDKAKYGRLLARYICKSATAYFPITLHVQDIHAFDPNRAYVLGYEPHSVLPIGVVALSDLTGFMPLQKIKVLASSAVFYTPFLRHIWTWMGLTPATKKNFISLLAAGYSCIIVPGGVQETFHMEHNSETVFLKTRRGFVRLAMEMGTPLVPVFCFGQSSVYHWWKPGGKLFLQFSRAIKFTPIVFWGVFGSPLPFRRRMHVVVGRPIEVKKNPNPTSDEVLDVHGQFVEALQDIFERYKAQLGYDNLQLKVL

SEQ ID NO: 27 - protein, 314 aa, Arabidopsis thaliana
MGGSREFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAIFYTPFLRHIWTWLGLTAASRKNFTSLLDSGYSCVLVPGGVQETFHMQHDAENVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 28 - DNA, 4004 bp, Artificial Sequence
  vector
aatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctcccggccgccatggcggccgcgggaattcgattagcggccgctcaaagaactttcagctgcagattatcatagccaagctgtgctttgtacctttcaaatatatcctggagtgcttcaacaaactgaccgtgtacatcaagaacctcatcactcgttgggtttggatttttcttcacctcaatgggtctccccaccaccacatgcatccgccgcctaaagggaaggggagatccgaaaactccccagaagacaattggagtgaacttgatcgctctagaaaattggaggaacaacttcccaccaggcttccaccaatgatagacgctcgactgaccaaagcagaaaactgggaccaggggtgtgcccatctccatcgctaagcgaacaaatcctcgtcttgtcttgaggaagacagtctccgaattatgctccatatgaaatgtctcttgtactccaccaggcacaatgatacaactatagccagctgccaagagggagatgaaatttttctttgttgctggcgttagacccatccatgtccatatgtgcctcaaaaacggtgtataaaacacagcggaactagcaaggacttttattttttggagaggcatgaaaccagtaaggtcgctcaatgcaacaacaccaataggtaaaaccgaatgtggctcataaccaagaacataagcacgattgggatcaaaggcatgtatatcttggacatgtagagtaataggaaaataggcggtagcgcttttacatatatacctggccaataagcgaccgtatttggctttgtcgttgacaggaattagcactaatatgaaaagtaaggcgccgaccgagagggctttggggagggagaggtagaagagggagatgaggcctagagcaaaattgagatgaatggcgccgagccaaatacacaaggctgcgattacgtgcaagtgcatcatccggcatttggtgggcgacccatctcccttgaaaactgtgaccgacggcaccatggtgcggccgct

SEQ ID NO: 29 - DNA, 5226 bp, Artificial Sequence
  vector
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccatggtcaatcaatgagacgccaacttcttaatctattgagacctgcaggtctagaagggcggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatggtgccgtcggtcacagttttcaagggagatgggtcgcccaccaaatgccggatgatgcacttgcacgtaatcgcagccttgtgtatttggctcggcgccattcatctcaattttgctctaggcctcatctccctcttctacctctccctccccaaagccctctcggtcggcgccttacttttcatattagtgctaattcctgtcaacgacaaagccaaatacggtcgcttattggccaggtatatatgtaaaagcgctaccgcctattttcctattactctacatgtccaagatatacatgcctttgatcccaatcgtgcttatgttcttggttatgagccacattcggttttacctattggtgttgttgcattgagcgaccttactggtttcatgcctctccaaaaaataaaagtccttgctagttccgctgtgttttatacaccgtttttgaggcacatatggacatggatgggtctaacgccagcaacaaagaaaaatttcatctccctcttggcagctggctatagttgtatcattgtgcctggtggagtacaagagacatttcatatggagcataattcggagactgtcttcctcaagacaagacgaggatttgttcgcttagcgatggagatgggcacacccctggtcccagttttctgctttggtcagtcgagcgtctatcattggtggaagcctggtgggaagttgttcctccaattttctagagcgatcaagttcactccaattgtcttctggggagttttcggatctccccttccctttaggcggcggatgcatgtggtggtggggagacccattgaggtgaagaaaaatccaaacccaacgagtgatgaggttcttgatgtacacggtcagtttgttgaagcactccaggatatatttgaaaggtacaaagcacagcttggctatgataatctgcagctgaaagttctttgagcctatgataatctgcagctgaaagttctttgagc

SEQ ID NO: 30 - DNA, 1200 bp, Momordica charantia
atggggggcagaggagctattggagtactgaggaacggtggcggcccaaaaaagaaaatggggccggggcaggggctggggccgggggagcgcattacacatgccaggcctcccttcagcatcagccagatcaagaaggccattcccccccactgctttcagcgatccctccgccgctctttttcctaccttctttccgacattgccctcgtctctgccttttattacgttgccgacacctacttccaccgcctgccccaccccctactccactacctggcctggcccgtttactggttctgtcagggcgccgtactcaccggcatgtggggcatcgctcacgactgcggccaccacgccttcagcgactaccaattggtagacgacgtggttgggttcctcatccactctttggtttttgtcccttacttctccttcaagatcagccaccgccgccaccactccaacacctcatccgtggaccgggacgaggtgttcgtccccaagccgaaggccaaaatgccctggtacttcaagtacttgacaaacccgcccgccagggtcttcattatttttatcacgctcactctcgggtggccaatgtacctgaccttcaacatctccggccggtactacggccggttcaccagccacttcgacccgaacagccccatattcagcccaaaggagcgcgttctcgttcatatctccaacgctgggcttgtggcgaccgggtatttgctgtacaggatcgcaatggcgaagggggtggggtggttgatccgcttgtacggagtgccgctgatcgttttaaacgcgtgcgtagttctgatcacagcgctgcagcacacccacccttcgttcccgtattacgactcgacggaatgggattggctgagagggaatctggtgacggtggacagagattacgggcctataatgaatagagtgtttcatcacataacggacacgcacgtggttcaccatttgtttccttcgatgccgcactacaacgggaaagaggcgacggttgcagcaaagcgaatactgggagagtactaccagtttgatgggaccccaatttggaaggcggcctggagggaattcagagagtgcgtttatgtagagccagacgaagacgatggggccacttccggctccagtagtaagggtgttttctggtaccacaacaagctctga

SEQ ID NO: 31 - DNA, 8293 bp, Artificial Sequence
  vector
ggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcagagcttgttgtggtaccagaaaacacccttactactggagccggaagtggccccatcgtcttcgtctggctctacataaacgcactctctgaattccctccaggccgccttccaaattggggtcccatcaaactggtagtactctcccagtattcgctttgctgcaaccgtcgcctctttcccgttgtagtgcggcatcgaaggaaacaaatggtgaaccacgtgcgtgtccgttatgtgatgaaacactctattcattataggcccgtaatctctgtccaccgtcaccagattccctctcagccaatcccattccgtcgagtcgtaatacgggaacgaagggtgggtgtgctgcagcgctgtgatcagaactacgcacgcgtttaaaacgatcagcggcactccgtacaagcggatcaaccaccccacccccttcgccattgcgatcctgtacagcaaatacccggtcgccacaagcccagcgttggagatatgaacgagaacgcgctcctttgggctgaatatggggctgttcgggtcgaagtggctggtgaaccggccgtagtaccggccggagatgttgaaggtcaggtacattggccacccgagagtgagcgtgataaaaataatgaagaccctggcgggcgggtttgtcaagtacttgaagtaccagggcattttggccttcggcttggggacgaacacctcgtcccggtccacggatgaggtgttggagtggtggcggcggtggctgatcttgaaggagaagtaagggacaaaaaccaaagagtggatgaggaacccaaccacgtcgtctaccaattggtagtcgctgaaggcgtggtggccgcagtcgtgagcgatgccccacatgccggtgagtacggcgccctgacagaaccagtaaacgggccaggccaggtagtggagtagggggtggggcaggcggtggaagtaggtgtcggcaacgtaataaaaggcagagacgagggcaatgtcggaaagaaggtaggaaaaagagcggcggagggatcgctgaaagcagtgggggggaatggccttcttgatctggctgatgctgaagggaggcctggcatgtgtaatgcgctcccccggccccagcccctgccccggccccattttcttttttgggccgccaccgttcctcagtactccaatagctcctctgccccccatgc

SEQ ID NO: 32 - DNA, 37 bp, Artificial Sequence
  primer
agcggccgcaccatgggcctggagatggaacccctcg

SEQ ID NO: 33 - DNA, 32 bp, Artificial Sequence
  primer
agcggccgctcactcttcttttcgagctttgg

SEQ ID NO: 34 - DNA, 4436 bp, Artificial Sequence
  vector
aatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctcccggccgccatggcggccgcgggaattcgattagcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgct

SEQ ID NO: 35 - DNA, 12262 bp, Artificial Sequence
  vector
  misc_feature (11087)..(11087): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatggggggcagaggagctattggagtactgaggaacggtggcggcccaaaaaagaaaatggggccggggcaggggctggggccgggggagcgcattacacatgccaggcctcccttcagcatcagccagatcaagaaggccattcccccccactgctttcagcgatccctccgccgctctttttcctaccttctttccgacattgccctcgtctctgccttttattacgttgccgacacctacttccaccgcctgccccaccccctactccactacctggcctggcccgtttactggttctgtcagggcgccgtactcaccggcatgtggggcatcgctcacgactgcggccaccacgccttcagcgactaccaattggtagacgacgtggttgggttcctcatccactctttggtttttgtcccttacttctccttcaagatcagccaccgccgccaccactccaacacctcatccgtggaccgggacgaggtgttcgtccccaagccgaaggccaaaatgccctggtacttcaagtacttgacaaacccgcccgccagggtcttcattatttttatcacgctcactctcgggtggccaatgtacctgaccttcaacatctccggccggtactacggccggttcaccagccacttcgacccgaacagccccatattcagcccaaaggagcgcgttctcgttcatatctccaacgctgggcttgtggcgaccgggtatttgctgtacaggatcgcaatggcgaagggggtggggtggttgatccgcttgtacggagtgccgctgatcgttttaaacgcgtgcgtagttctgatcacagcgctgcagcacacccacccttcgttcccgtattacgactcgacggaatgggattggctgagagggaatctggtgacggtggacagagattacgggcctataatgaatagagtgtttcatcacataacggacacgcacgtggttcaccatttgtttccttcgatgccgcactacaacgggaaagaggcgacggttgcagcaaagcgaatactgggagagtactaccagtttgatgggaccccaatttggaaggcggcctggagggaattcagagagtgcgtttatgtagagccagacgaagacgatggggccacttccggctccagtagtaagggtgttttctggtaccacaacaagctctgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 36 - DNA, 14769 bp, Artificial Sequence
  vector
  misc_feature (11058)..(11058): n is a, c, g, or t
ggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatggggggcagaggagctattggagtactgaggaacggtggcggcccaaaaaagaaaatggggccggggcaggggctggggccgggggagcgcattacacatgccaggcctcccttcagcatcagccagatcaagaaggccattcccccccactgctttcagcgatccctccgccgctctttttcctaccttctttccgacattgccctcgtctctgccttttattacgttgccgacacctacttccaccgcctgccccaccccctactccactacctggcctggcccgtttactggttctgtcagggcgccgtactcaccggcatgtggggcatcgctcacgactgcggccaccacgccttcagcgactaccaattggtagacgacgtggttgggttcctcatccactctttggtttttgtcccttacttctccttcaagatcagccaccgccgccaccactccaacacctcatccgtggaccgggacgaggtgttcgtccccaagccgaaggccaaaatgccctggtacttcaagtacttgacaaacccgcccgccagggtcttcattatttttatcacgctcactctcgggtggccaatgtacctgaccttcaacatctccggccggtactacggccggttcaccagccacttcgacccgaacagccccatattcagcccaaaggagcgcgttctcgttcatatctccaacgctgggcttgtggcgaccgggtatttgctgtacaggatcgcaatggcgaagggggtggggtggttgatccgcttgtacggagtgccgctgatcgttttaaacgcgtgcgtagttctgatcacagcgctgcagcacacccacccttcgttcccgtattacgactcgacggaatgggattggctgagagggaatctggtgacggtggacagagattacgggcctataatgaatagagtgtttcatcacataacggacacgcacgtggttcaccatttgtttccttcgatgccgcactacaacgggaaagaggcgacggttgcagcaaagcgaatactgggagagtactaccagtttgatgggaccccaatttggaaggcggcctggagggaattcagagagtgcgtttatgtagagccagacgaagacgatggggccacttccggctccagtagtaagggtgttttctggtaccacaacaagctctgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgagatccggccggccagatcctgcaggtctcaatagattaagaagttggcgtctcattgattgaccatgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcaaagaactttcagctgcagattatcatagccaagctgtgctttgtacctttcaaatatatcctggagtgcttcaacaaactgaccgtgtacatcaagaacctcatcactcgttgggtttggatttttcttcacctcaatgggtctccccaccaccacatgcatccgccgcctaaagggaaggggagatccgaaaactccccagaagacaattggagtgaacttgatcgctctagaaaattggaggaacaacttcccaccaggcttccaccaatgatagacgctcgactgaccaaagcagaaaactgggaccaggggtgtgcccatctccatcgctaagcgaacaaatcctcgtcttgtcttgaggaagacagtctccgaattatgctccatatgaaatgtctcttgtactccaccaggcacaatgatacaactatagccagctgccaagagggagatgaaatttttctttgttgctggcgttagacccatccatgtccatatgtgcctcaaaaacggtgtataaaacacagcggaactagcaaggacttttattttttggagaggcatgaaaccagtaaggtcgctcaatgcaacaacaccaataggtaaaaccgaatgtggctcataaccaagaacataagcacgattgggatcaaaggcatgtatatcttggacatgtagagtaataggaaaataggcggtagcgcttttacatatatacctggccaataagcgaccgtatttggctttgtcgttgacaggaattagcactaatatgaaaagtaaggcgccgaccgagagggctttggggagggagaggtagaagagggagatgaggcctagagcaaaattgagatgaatggcgccgagccaaatacacaaggctgcgattacgtgcaagtgcatcatccggcatttggtgggcgacccatctcccttgaaaactgtgaccgacggcaccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgca

SEQ ID NO: 37 - DNA, 10712 bp, Artificial Sequence
  vector
gtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcaaagaactttcagctgcagattatcatagccaagctgtgctttgtacctttcaaatatatcctggagtgcttcaacaaactgaccgtgtacatcaagaacctcatcactcgttgggtttggatttttcttcacctcaatgggtctccccaccaccacatgcatccgccgcctaaagggaaggggagatccgaaaactccccagaagacaattggagtgaacttgatcgctctagaaaattggaggaacaacttcccaccaggcttccaccaatgatagacgctcgactgaccaaagcagaaaactgggaccaggggtgtgcccatctccatcgctaagcgaacaaatcctcgtcttgtcttgaggaagacagtctccgaattatgctccatatgaaatgtctcttgtactccaccaggcacaatgatacaactatagccagctgccaagagggagatgaaatttttctttgttgctggcgttagacccatccatgtccatatgtgcctcaaaaacggtgtataaaacacagcggaactagcaaggacttttattttttggagaggcatgaaaccagtaaggtcgctcaatgcaacaacaccaataggtaaaaccgaatgtggctcataaccaagaacataagcacgattgggatcaaaggcatgtatatcttggacatgtagagtaataggaaaataggcggtagcgcttttacatatatacctggccaataagcgaccgtatttggctttgtcgttgacaggaattagcactaatatgaaaagtaaggcgccgaccgagagggctttggggagggagaggtagaagagggagatgaggcctagagcaaaattgagatgaatggcgccgagccaaatacacaaggctgcgattacgtgcaagtgcatcatccggcatttggtgggcgacccatctcccttgaaaactgtgaccgacggcaccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatggggggcagaggagctattggagtactgaggaacggtggcggcccaaaaaagaaaatggggccggggcaggggctggggccgggggagcgcattacacatgccaggcctcccttcagcatcagccagatcaagaaggccattcccccccactgctttcagcgatccctccgccgctctttttcctaccttctttccgacattgccctcgtctctgccttttattacgttgccgacacctacttccaccgcctgccccaccccctactccactacctggcctggcccgtttactggttctgtcagggcgccgtactcaccggcatgtggggcatcgctcacgactgcggccaccacgccttcagcgactaccaattggtagacgacgtggttgggttcctcatccactctttggtttttgtcccttacttctccttcaagatcagccaccgccgccaccactccaacacctcatccgtggaccgggacgaggtgttcgtccccaagccgaaggccaaaatgccctggtacttcaagtacttgacaaacccgcccgccagggtcttcattatttttatcacgctcactctcgggtggccaatgtacctgaccttcaacatctccggccggtactacggccggttcaccagccacttcgacccgaacagccccatattcagcccaaaggagcgcgttctcgttcatatctccaacgctgggcttgtggcgaccgggtatttgctgtacaggatcgcaatggcgaagggggtggggtggttgatccgcttgtacggagtgccgctgatcgttttaaacgcgtgcgtagttctgatcacagcgctgcagcacacccacccttcgttcccgtattacgactcgacggaatgggattggctgagagggaatctggtgacggtggacagagattacgggcctataatgaatagagtgtttcatcacataacggacacgcacgtggttcaccatttgtttccttcgatgccgcactacaacgggaaagaggcgacggttgcagcaaagcgaatactgggagagtactaccagtttgatgggaccccaatttggaaggcggcctggagggaattcagagagtgcgtttatgtagagccagacgaagacgatggggccacttccggctccagtagtaagggtgttttctggtaccacaacaagctctgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatcc

SEQ ID NO: 38 - DNA, 38 bp, Artificial Sequence
  primer
agcggccgcaccatgtcgaagacggaggagacaaatgg

SEQ ID NO: 39 - DNA, 36 bp, Artificial Sequence
  primer
agcggccgctcacatcacacgtaactccatatcagg

SEQ ID NO: 40 - DNA, 5156 bp, Artificial Sequence
  vector
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtcgaagacggaggagacaaatggattaatcctgccaccaccaccagcagcagcagaaccaccaacaccggcgttgttcacaagtaaaatcatttcaccaattcatacatatgttgcacttttagtgtggctcggtgctgttcattttatcggaattattaatgtcaccaccttcttattgctcccctttcacaaatacctcctggtagtgggaatatttgtggtcttgatgttcatccccattaatgaggacagtaaatggggcttagctttagccaggtacatatataagcatgggggtggtcatttccctgcttctgtatatgttgaagatattaaagcattcaatcctgatcagacttacgtttttggatacgaaccccattcggtttgtccatttggagctggggcaatatcacatttcaccggttttttgcctacaggcaaagtcaagatccttgcaagtaccgctgtgttcttaacgccgttcatgaggcatatatggacatggatgggagtgtcaccggcaacaagggaaaacttcaagtctcttttaaaaaacggttatagttgcgtagttgtcccaggtggagtacgtgaggtcttttacatggagcctaattcagaggttgcctttttaaaagcaagaaaagggttcatacgtctcgcaatggagactggttctcccttggtccctgttttcgcctttgggcagtcagctgcttaccagtattggaggccaaagggggaactttatctgaaactgacccgagctgtcaagttcacgcctatatttttcgggggtaaattttggtctcctataccgtttcgacgacctgttcttgtggtggtcggtaagccaatacaagtgaagaagagttctactcccactatggaagaggttaatgaagtacatgatgagtttgtgaaagcacttaaagagttatttgatacgcataaagcacgagcaggatatcctgatatggagttacgtgtgatgtgagc

SEQ ID NO: 41 - DNA, 1119 bp, Calendula officinalis
atgggcaaggcagcatcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacaaggtatttattggtttaaaaataagacttga

SEQ ID NO: 42 - DNA, 8229 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgctataccatgggcaaggcagcatcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacaaggtatttattggtttaaaaataagacttgaagtttaacatagc

SEQ ID NO: 43 - DNA, 31 bp, Artificial Sequence
  primer
agcggccgcaccatggatatggaatcaacgg

SEQ ID NO: 44 - DNA, 48 bp, Artificial Sequence
  primer
gcatcgtttccgatagaccaccattgacacgtaactgaccaacatagg

SEQ ID NO: 45 - DNA, 48 bp, Artificial Sequence
  primer
cctatgttggtcagttacgtgtcaatggtggtctatcggaaacgatgc

SEQ ID NO: 46 - DNA, 32 bp, Artificial Sequence
  primer
agcggccgctcattgatcttttcgtgctttag

SEQ ID NO: 47 - DNA, 1389 bp, Calendula officinalis
atggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtcaatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatga

SEQ ID NO: 48 - DNA, 4921 bp, Artificial Sequence
  vector
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtcaatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatgagcggccgc

SEQ ID NO: 49 - DNA, 12189 bp, Artificial Sequence
  vector
  misc_feature (11014)..(11014): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgctataccatgggcaaggcagcatcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacaaggtatttattggtttaaaaataagacttgaagtttaacatagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcattgatcttttcgtgctttagatctaacaggctttgttttgattacattaccaagaaggattaaaaccacaggaataatagttccaatgtagtatacactcccgtatgcagtcactgtttcgtgtaggcttaataccatgaaaccaacacatgagtagttgagaacgagaagtgtataagcgaagtttacaagcataaaaatcttcttaagcaaccccaaatttgggggaacagattgctgccatctgtaaatggctcttgaaccagcaatcatcaaagctgattgaacaaaaaatatgatgtaccctggatataatccatgccatacagcactaacagtctgtgttgcaagcaattggaagaaaccagcctttttcccctttttaacaagtctgtcataaacatagtgacgaagccatgtgctgacttgaatattccatacaagtggtatctccactgcactcctagcaaactcaacacccaaaacatcaacatttttagcccggtcccaccgggccttgggtggagaagaatcggcccacccactaaagcccaaaccagaaataacaatagaagcttctgaaatggaccatatgaaataatatttccaacgggccgtaaagcccgccatgtattggtaactcaatcgtttccagaatccccattctttatatatcgggtcagtgaattttgataacgggtaatgaggtaccaaatataagtacaaacccatacagacaccagcttgaacaagagctttgacggttggcccgaaaggtgatggtgaacccttttccgactttatccagatccctttgccttctgtccaatctaagtaatccttaatttcataaactgggcctgcaaaatgacttccacaacaaagacaaaatcccacatactcgattaaagaaggcagcttaagtaactgatttttcttctgggattcgcgaagatcttcatcttttagtaatccatcattgtaattaatcgcgcacgaaataacttttaatgttattaccataagagctccagtagcatcaatacctccttccttccatgcatccccactcatgtagtatacatggcatccaatgaggtatcccatagctaacacgaatgtaattaagccgcatcgtttccgatagaccaccattgacacgtaactgaccaacataggcacgagaaagtgtagatttgaagagaaaccaaaggataagtaagagagtacaacgccggtagaggcggcgtacaagtgttttccggtggggccgccggggatgaggcgatggaaaaagccggcaggaatagtggcgacgaagcatagaaggaatcggagtaccggcaccgatactccgatagccgtcgccgttgattccatatccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 50 - DNA, 14692 bp, Artificial Sequence
  vector
  misc_feature (10985)..(10985): n is a, c, g, or t
ggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgctataccatgggcaaggcagcatcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacaaggtatttattggtttaaaaataagacttgaagtttaacatagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcattgatcttttcgtgctttagatctaacaggctttgttttgattacattaccaagaaggattaaaaccacaggaataatagttccaatgtagtatacactcccgtatgcagtcactgtttcgtgtaggcttaataccatgaaaccaacacatgagtagttgagaacgagaagtgtataagcgaagtttacaagcataaaaatcttcttaagcaaccccaaatttgggggaacagattgctgccatctgtaaatggctcttgaaccagcaatcatcaaagctgattgaacaaaaaatatgatgtaccctggatataatccatgccatacagcactaacagtctgtgttgcaagcaattggaagaaaccagcctttttcccctttttaacaagtctgtcataaacatagtgacgaagccatgtgctgacttgaatattccatacaagtggtatctccactgcactcctagcaaactcaacacccaaaacatcaacatttttagcccggtcccaccgggccttgggtggagaagaatcggcccacccactaaagcccaaaccagaaataacaatagaagcttctgaaatggaccatatgaaataatatttccaacgggccgtaaagcccgccatgtattggtaactcaatcgtttccagaatccccattctttatatatcgggtcagtgaattttgataacgggtaatgaggtaccaaatataagtacaaacccatacagacaccagcttgaacaagagctttgacggttggcccgaaaggtgatggtgaacccttttccgactttatccagatccctttgccttctgtccaatctaagtaatccttaatttcataaactgggcctgcaaaatgacttccacaacaaagacaaaatcccacatactcgattaaagaaggcagcttaagtaactgatttttcttctgggattcgcgaagatcttcatcttttagtaatccatcattgtaattaatcgcgcacgaaataacttttaatgttattaccataagagctccagtagcatcaatacctccttccttccatgcatccccactcatgtagtatacatggcatccaatgaggtatcccatagctaacacgaatgtaattaagccgcatcgtttccgatagaccaccattgacacgtaactgaccaacataggcacgagaaagtgtagatttgaagagaaaccaaaggataagtaagagagtacaacgccggtagaggcggcgtacaagtgttttccggtggggccgccggggatgaggcgatggaaaaagccggcaggaatagtggcgacgaagcatagaaggaatcggagtaccggcaccgatactccgatagccgtcgccgttgattccatatccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgagatccggccggccagatcctgcagcccgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcacatcacacgtaactccatatcaggatatcctgctcgtgctttatgcgtatcaaataactctttaagtgctttcacaaactcatcatgtacttcattaacctcttccatagtgggagtagaactcttcttcacttgtattggcttaccgaccaccacaagaacaggtcgtcgaaacggtataggagaccaaaatttacccccgaaaaatataggcgtgaacttgacagctcgggtcagtttcagataaagttccccctttggcctccaatactggtaagcagctgactgcccaaaggcgaaaacagggaccaagggagaaccagtctccattgcgagacgtatgaacccttttcttgcttttaaaaaggcaacctctgaattaggctccatgtaaaagacctcacgtactccacctgggacaactacgcaactataaccgttttttaaaagagacttgaagttttcccttgttgccggtgacactcccatccatgtccatatatgcctcatgaacggcgttaagaacacagcggtacttgcaaggatcttgactttgcctgtaggcaaaaaaccggtgaaatgtgatattgccccagctccaaatggacaaaccgaatggggttcgtatccaaaaacgtaagtctgatcaggattgaatgctttaatatcttcaacatatacagaagcagggaaatgaccacccccatgcttatatatgtacctggctaaagctaagccccatttactgtcctcattaatggggatgaacatcaagaccacaaatattcccactaccaggaggtatttgtgaaaggggagcaataagaaggtggtgacattaataattccgataaaatgaacagcaccgagccacactaaaagtgcaacatatgtatgaattggtgaaatgattttacttgtgaacaacgccggtgttggtggttctgctgctgctggtggtggtggcaggattaatccatttgtctcctccgtcttcgacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgca

SEQ ID NO: 51 - DNA, 10683 bp, Artificial Sequence
  vector
gtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcacatcacacgtaactccatatcaggatatcctgctcgtgctttatgcgtatcaaataactctttaagtgctttcacaaactcatcatgtacttcattaacctcttccatagtgggagtagaactcttcttcacttgtattggcttaccgaccaccacaagaacaggtcgtcgaaacggtataggagaccaaaatttacccccgaaaaatataggcgtgaacttgacagctcgggtcagtttcagataaagttccccctttggcctccaatactggtaagcagctgactgcccaaaggcgaaaacagggaccaagggagaaccagtctccattgcgagacgtatgaacccttttcttgcttttaaaaaggcaacctctgaattaggctccatgtaaaagacctcacgtactccacctgggacaactacgcaactataaccgttttttaaaagagacttgaagttttcccttgttgccggtgacactcccatccatgtccatatatgcctcatgaacggcgttaagaacacagcggtacttgcaaggatcttgactttgcctgtaggcaaaaaaccggtgaaatgtgatattgccccagctccaaatggacaaaccgaatggggttcgtatccaaaaacgtaagtctgatcaggattgaatgctttaatatcttcaacatatacagaagcagggaaatgaccacccccatgcttatatatgtacctggctaaagctaagccccatttactgtcctcattaatggggatgaacatcaagaccacaaatattcccactaccaggaggtatttgtgaaaggggagcaataagaaggtggtgacattaataattccgataaaatgaacagcaccgagccacactaaaagtgcaacatatgtatgaattggtgaaatgattttacttgtgaacaacgccggtgttggtggttctgctgctgctggtggtggtggcaggattaatccatttgtctcctccgtcttcgacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgctataccatgggcaaggcagcatcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacaaggtatttattggtttaaaaataagacttgaagtttaacatagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatcc

SEQ ID NO: 52 - DNA, 16321 bp, Artificial Sequence
  vector
cgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcagagcttgttgtggtaccagaaaacacccttactactggagccggaagtggccccatcgtcttcgtctggctctacataaacgcactctctgaattccctccaggccgccttccaaattggggtcccatcaaactggtagtactctcccagtattcgctttgctgcaaccgtcgcctctttcccgttgtagtgcggcatcgaaggaaacaaatggtgaaccacgtgcgtgtccgttatgtgatgaaacactctattcattataggcccgtaatctctgtccaccgtcaccagattccctctcagccaatcccattccgtcgagtcgtaatacgggaacgaagggtgggtgtgctgcagcgctgtgatcagaactacgcacgcgtttaaaacgatcagcggcactccgtacaagcggatcaaccaccccacccccttcgccattgcgatcctgtacagcaaatacccggtcgccacaagcccagcgttggagatatgaacgagaacgcgctcctttgggctgaatatggggctgttcgggtcgaagtggctggtgaaccggccgtagtaccggccggagatgttgaaggtcaggtacattggccacccgagagtgagcgtgataaaaataatgaagaccctggcgggcgggtttgtcaagtacttgaagtaccagggcattttggccttcggcttggggacgaacacctcgtcccggtccacggatgaggtgttggagtggtggcggcggtggctgatcttgaaggagaagtaagggacaaaaaccaaagagtggatgaggaacccaaccacgtcgtctaccaattggtagtcgctgaaggcgtggtggccgcagtcgtgagcgatgccccacatgccggtgagtacggcgccctgacagaaccagtaaacgggccaggccaggtagtggagtagggggtggggcaggcggtggaagtaggtgtcggcaacgtaataaaaggcagagacgagggcaatgtcggaaagaaggtaggaaaaagagcggcggagggatcgctgaaagcagtgggggggaatggccttcttgatctggctgatgctgaagggaggcctggcatgtgtaatgcgctcccccggccccagcccctgccccggccccattttcttttttgggccgccaccgttcctcagtactccaatagctcctctgccccccatgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctcgtacggatccgtcgacggcgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagtctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatctgg

SEQ ID NO: 53 - DNA, 20290 bp, Artificial Sequence
  vector
  misc_feature (16080)..(16080): n is a, c, g, or t
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatggggggcagaggagctattggagtactgaggaacggtggcggcccaaaaaagaaaatggggccggggcaggggctggggccgggggagcgcattacacatgccaggcctcccttcagcatcagccagatcaagaaggccattcccccccactgctttcagcgatccctccgccgctctttttcctaccttctttccgacattgccctcgtctctgccttttattacgttgccgacacctacttccaccgcctgccccaccccctactccactacctggcctggcccgtttactggttctgtcagggcgccgtactcaccggcatgtggggcatcgctcacgactgcggccaccacgccttcagcgactaccaattggtagacgacgtggttgggttcctcatccactctttggtttttgtcccttacttctccttcaagatcagccaccgccgccaccactccaacacctcatccgtggaccgggacgaggtgttcgtccccaagccgaaggccaaaatgccctggtacttcaagtacttgacaaacccgcccgccagggtcttcattatttttatcacgctcactctcgggtggccaatgtacctgaccttcaacatctccggccggtactacggccggttcaccagccacttcgacccgaacagccccatattcagcccaaaggagcgcgttctcgttcatatctccaacgctgggcttgtggcgaccgggtatttgctgtacaggatcgcaatggcgaagggggtggggtggttgatccgcttgtacggagtgccgctgatcgttttaaacgcgtgcgtagttctgatcacagcgctgcagcacacccacccttcgttcccgtattacgactcgacggaatgggattggctgagagggaatctggtgacggtggacagagattacgggcctataatgaatagagtgtttcatcacataacggacacgcacgtggttcaccatttgtttccttcgatgccgcactacaacgggaaagaggcgacggttgcagcaaagcgaatactgggagagtactaccagtttgatgggaccccaatttggaaggcggcctggagggaattcagagagtgcgtttatgtagagccagacgaagacgatggggccacttccggctccagtagtaagggtgttttctggtaccacaacaagctctgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 54 - DNA, 22797 bp, Artificial Sequence
  vector
  misc_feature (16080)..(16080): n is a , c, g, or t
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgagatccggccggccagatcctgcaggtctcaatagattaagaagttggcgtctcattgattgaccatgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcaaagaactttcagctgcagattatcatagccaagctgtgctttgtacctttcaaatatatcctggagtgcttcaacaaactgaccgtgtacatcaagaacctcatcactcgttgggtttggatttttcttcacctcaatgggtctccccaccaccacatgcatccgccgcctaaagggaaggggagatccgaaaactccccagaagacaattggagtgaacttgatcgctctagaaaattggaggaacaacttcccaccaggcttccaccaatgatagacgctcgactgaccaaagcagaaaactgggaccaggggtgtgcccatctccatcgctaagcgaacaaatcctcgtcttgtcttgaggaagacagtctccgaattatgctccatatgaaatgtctcttgtactccaccaggcacaatgatacaactatagccagctgccaagagggagatgaaatttttctttgttgctggcgttagacccatccatgtccatatgtgcctcaaaaacggtgtataaaacacagcggaactagcaaggacttttattttttggagaggcatgaaaccagtaaggtcgctcaatgcaacaacaccaataggtaaaaccgaatgtggctcataaccaagaacataagcacgattgggatcaaaggcatgtatatcttggacatgtagagtaataggaaaataggcggtagcgcttttacatatatacctggccaataagcgaccgtatttggctttgtcgttgacaggaattagcactaatatgaaaagtaaggcgccgaccgagagggctttggggagggagaggtagaagagggagatgaggcctagagcaaaattgagatgaatggcgccgagccaaatacacaaggctgcgattacgtgcaagtgcatcatccggcatttggtgggcgacccatctcccttgaaaactgtgaccgacggcaccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatggggggcagaggagctattggagtactgaggaacggtggcggcccaaaaaagaaaatggggccggggcaggggctggggccgggggagcgcattacacatgccaggcctcccttcagcatcagccagatcaagaaggccattcccccccactgctttcagcgatccctccgccgctctttttcctaccttctttccgacattgccctcgtctctgccttttattacgttgccgacacctacttccaccgcctgccccaccccctactccactacctggcctggcccgtttactggttctgtcagggcgccgtactcaccggcatgtggggcatcgctcacgactgcggccaccacgccttcagcgactaccaattggtagacgacgtggttgggttcctcatccactctttggtttttgtcccttacttctccttcaagatcagccaccgccgccaccactccaacacctcatccgtggaccgggacgaggtgttcgtccccaagccgaaggccaaaatgccctggtacttcaagtacttgacaaacccgcccgccagggtcttcattatttttatcacgctcactctcgggtggccaatgtacctgaccttcaacatctccggccggtactacggccggttcaccagccacttcgacccgaacagccccatattcagcccaaaggagcgcgttctcgttcatatctccaacgctgggcttgtggcgaccgggtatttgctgtacaggatcgcaatggcgaagggggtggggtggttgatccgcttgtacggagtgccgctgatcgttttaaacgcgtgcgtagttctgatcacagcgctgcagcacacccacccttcgttcccgtattacgactcgacggaatgggattggctgagagggaatctggtgacggtggacagagattacgggcctataatgaatagagtgtttcatcacataacggacacgcacgtggttcaccatttgtttccttcgatgccgcactacaacgggaaagaggcgacggttgcagcaaagcgaatactgggagagtactaccagtttgatgggaccccaatttggaaggcggcctggagggaattcagagagtgcgtttatgtagagccagacgaagacgatggggccacttccggctccagtagtaagggtgttttctggtaccacaacaagctctgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 55 - DNA, 18740 bp, Artificial Sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcaaagaactttcagctgcagattatcatagccaagctgtgctttgtacctttcaaatatatcctggagtgcttcaacaaactgaccgtgtacatcaagaacctcatcactcgttgggtttggatttttcttcacctcaatgggtctccccaccaccacatgcatccgccgcctaaagggaaggggagatccgaaaactccccagaagacaattggagtgaacttgatcgctctagaaaattggaggaacaacttcccaccaggcttccaccaatgatagacgctcgactgaccaaagcagaaaactgggaccaggggtgtgcccatctccatcgctaagcgaacaaatcctcgtcttgtcttgaggaagacagtctccgaattatgctccatatgaaatgtctcttgtactccaccaggcacaatgatacaactatagccagctgccaagagggagatgaaatttttctttgttgctggcgttagacccatccatgtccatatgtgcctcaaaaacggtgtataaaacacagcggaactagcaaggacttttattttttggagaggcatgaaaccagtaaggtcgctcaatgcaacaacaccaataggtaaaaccgaatgtggctcataaccaagaacataagcacgattgggatcaaaggcatgtatatcttggacatgtagagtaataggaaaataggcggtagcgcttttacatatatacctggccaataagcgaccgtatttggctttgtcgttgacaggaattagcactaatatgaaaagtaaggcgccgaccgagagggctttggggagggagaggtagaagagggagatgaggcctagagcaaaattgagatgaatggcgccgagccaaatacacaaggctgcgattacgtgcaagtgcatcatccggcatttggtgggcgacccatctcccttgaaaactgtgaccgacggcaccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatggggggcagaggagctattggagtactgaggaacggtggcggcccaaaaaagaaaatggggccggggcaggggctggggccgggggagcgcattacacatgccaggcctcccttcagcatcagccagatcaagaaggccattcccccccactgctttcagcgatccctccgccgctctttttcctaccttctttccgacattgccctcgtctctgccttttattacgttgccgacacctacttccaccgcctgccccaccccctactccactacctggcctggcccgtttactggttctgtcagggcgccgtactcaccggcatgtggggcatcgctcacgactgcggccaccacgccttcagcgactaccaattggtagacgacgtggttgggttcctcatccactctttggtttttgtcccttacttctccttcaagatcagccaccgccgccaccactccaacacctcatccgtggaccgggacgaggtgttcgtccccaagccgaaggccaaaatgccctggtacttcaagtacttgacaaacccgcccgccagggtcttcattatttttatcacgctcactctcgggtggccaatgtacctgaccttcaacatctccggccggtactacggccggttcaccagccacttcgacccgaacagccccatattcagcccaaaggagcgcgttctcgttcatatctccaacgctgggcttgtggcgaccgggtatttgctgtacaggatcgcaatggcgaagggggtggggtggttgatccgcttgtacggagtgccgctgatcgttttaaacgcgtgcgtagttctgatcacagcgctgcagcacacccacccttcgttcccgtattacgactcgacggaatgggattggctgagagggaatctggtgacggtggacagagattacgggcctataatgaatagagtgtttcatcacataacggacacgcacgtggttcaccatttgtttccttcgatgccgcactacaacgggaaagaggcgacggttgcagcaaagcgaatactgggagagtactaccagtttgatgggaccccaatttggaaggcggcctggagggaattcagagagtgcgtttatgtagagccagacgaagacgatggggccacttccggctccagtagtaagggtgttttctggtaccacaacaagctctgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 56 - DNA, 16257 bp, Artificial Sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgctataccatgggcaaggcagcatcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacaaggtatttattggtttaaaaataagacttgaagtttaacatagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 57 - DNA, 20217 bp, Artificial Sequence
  vector
  misc_feature (17419)..(17419): n is a, c, g, or t
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctatgttaaacttcaagtcttatttttaaaccaataaataccttgtttcttctgaccttcatcggattctacataaatacactccttcatttctctccacaaggcctttagaaacggagtaccatcatacttgtaatattgacctaagatgggcttgatggcctcggttgcctcttgtgcatggtattccggaatgacaggaaacaaatggtggataacatgataatgtgttttgttcatgttgaagaaccctaaatctctatcaattgtcgataaagcccctctaagccagttccactccgttgtatcataatgagggattgaaggatgagtgtgttgtaaataagttgctgcaaagagaatagcactcattataacccaaggaataccgtacacataaaatgccggcattgcccctgtgaccgtcacaatacggtaacacgcgtacaagacgatgcaaatcccgatgtcagagaacaaaacatggttacgttcgctgtcgttaaagagagggctttgtgggtagaagtggctcgctaagcccccagatttgtgcttcttacctgtgtaattgaacataatgtaagctgcatatccgaaagtcagtttacatagcatggtgatcattaagccgattgggttgttgcccagaaattcaaagtagagagcttctgatttgcgtttcgggatatgaacctcgtcgtattccatggaattggtgtgtgcatggtgattacggtggctatatttgaaggaaaaatagggagtgagggtggccgtatggattagaaaaccgactgtatcgtcgacccaacggtaattactgaagctatgatgaccgcattcgtggccgatcatccacaatctgccgagaaaaactccttgggagatccagtaaacaggccatacgatgcaggaaaggaaacgagggagcatatgaatgtagtttgatgctacgtagaaaaggatacatgttacaataatgtcgtgaaagaggaaatacaaggatcgggaaagtggtcgtgaaaaacaatgtggtggtactgctttcttcagatcattgtattcgaatggcggttttgagattggaactcgctccaaaaccttcttggctgatgctgccttgcccatggtatagcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtcaatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatgagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacggatccgtcgacgg

SEQ ID NO: 58 - DNA, 22720 bp, Artificial Sequence
  vector
  misc_feature (19922)..(19922): n is a, c, g, or t
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctatgttaaacttcaagtcttatttttaaaccaataaataccttgtttcttctgaccttcatcggattctacataaatacactccttcatttctctccacaaggcctttagaaacggagtaccatcatacttgtaatattgacctaagatgggcttgatggcctcggttgcctcttgtgcatggtattccggaatgacaggaaacaaatggtggataacatgataatgtgttttgttcatgttgaagaaccctaaatctctatcaattgtcgataaagcccctctaagccagttccactccgttgtatcataatgagggattgaaggatgagtgtgttgtaaataagttgctgcaaagagaatagcactcattataacccaaggaataccgtacacataaaatgccggcattgcccctgtgaccgtcacaatacggtaacacgcgtacaagacgatgcaaatcccgatgtcagagaacaaaacatggttacgttcgctgtcgttaaagagagggctttgtgggtagaagtggctcgctaagcccccagatttgtgcttcttacctgtgtaattgaacataatgtaagctgcatatccgaaagtcagtttacatagcatggtgatcattaagccgattgggttgttgcccagaaattcaaagtagagagcttctgatttgcgtttcgggatatgaacctcgtcgtattccatggaattggtgtgtgcatggtgattacggtggctatatttgaaggaaaaatagggagtgagggtggccgtatggattagaaaaccgactgtatcgtcgacccaacggtaattactgaagctatgatgaccgcattcgtggccgatcatccacaatctgccgagaaaaactccttgggagatccagtaaacaggccatacgatgcaggaaaggaaacgagggagcatatgaatgtagtttgatgctacgtagaaaaggatacatgttacaataatgtcgtgaaagaggaaatacaaggatcgggaaagtggtcgtgaaaaacaatgtggtggtactgctttcttcagatcattgtattcgaatggcggttttgagattggaactcgctccaaaaccttcttggctgatgctgccttgcccatggtatagcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtcgaagacggaggagacaaatggattaatcctgccaccaccaccagcagcagcagaaccaccaacaccggcgttgttcacaagtaaaatcatttcaccaattcatacatatgttgcacttttagtgtggctcggtgctgttcattttatcggaattattaatgtcaccaccttcttattgctcccctttcacaaatacctcctggtagtgggaatatttgtggtcttgatgttcatccccattaatgaggacagtaaatggggcttagctttagccaggtacatatataagcatgggggtggtcatttccctgcttctgtatatgttgaagatattaaagcattcaatcctgatcagacttacgtttttggatacgaaccccattcggtttgtccatttggagctggggcaatatcacatttcaccggttttttgcctacaggcaaagtcaagatccttgcaagtaccgctgtgttcttaacgccgttcatgaggcatatatggacatggatgggagtgtcaccggcaacaagggaaaacttcaagtctcttttaaaaaacggttatagttgcgtagttgtcccaggtggagtacgtgaggtcttttacatggagcctaattcagaggttgcctttttaaaagcaagaaaagggttcatacgtctcgcaatggagactggttctcccttggtccctgttttcgcctttgggcagtcagctgcttaccagtattggaggccaaagggggaactttatctgaaactgacccgagctgtcaagttcacgcctatatttttcgggggtaaattttggtctcctataccgtttcgacgacctgttcttgtggtggtcggtaagccaatacaagtgaagaagagttctactcccactatggaagaggttaatgaagtacatgatgagtttgtgaaagcacttaaagagttatttgatacgcataaagcacgagcaggatatcctgatatggagttacgtgtgatgtgagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggatctggccggccggatctcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtcaatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatgagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacggatccgtcgacgg

SEQ ID NO: 59 - DNA, 18711 bp, Artificial Sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctatgttaaacttcaagtcttatttttaaaccaataaataccttgtttcttctgaccttcatcggattctacataaatacactccttcatttctctccacaaggcctttagaaacggagtaccatcatacttgtaatattgacctaagatgggcttgatggcctcggttgcctcttgtgcatggtattccggaatgacaggaaacaaatggtggataacatgataatgtgttttgttcatgttgaagaaccctaaatctctatcaattgtcgataaagcccctctaagccagttccactccgttgtatcataatgagggattgaaggatgagtgtgttgtaaataagttgctgcaaagagaatagcactcattataacccaaggaataccgtacacataaaatgccggcattgcccctgtgaccgtcacaatacggtaacacgcgtacaagacgatgcaaatcccgatgtcagagaacaaaacatggttacgttcgctgtcgttaaagagagggctttgtgggtagaagtggctcgctaagcccccagatttgtgcttcttacctgtgtaattgaacataatgtaagctgcatatccgaaagtcagtttacatagcatggtgatcattaagccgattgggttgttgcccagaaattcaaagtagagagcttctgatttgcgtttcgggatatgaacctcgtcgtattccatggaattggtgtgtgcatggtgattacggtggctatatttgaaggaaaaatagggagtgagggtggccgtatggattagaaaaccgactgtatcgtcgacccaacggtaattactgaagctatgatgaccgcattcgtggccgatcatccacaatctgccgagaaaaactccttgggagatccagtaaacaggccatacgatgcaggaaaggaaacgagggagcatatgaatgtagtttgatgctacgtagaaaaggatacatgttacaataatgtcgtgaaagaggaaatacaaggatcgggaaagtggtcgtgaaaaacaatgtggtggtactgctttcttcagatcattgtattcgaatggcggttttgagattggaactcgctccaaaaccttcttggctgatgctgccttgcccatggtatagcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtcgaagacggaggagacaaatggattaatcctgccaccaccaccagcagcagcagaaccaccaacaccggcgttgttcacaagtaaaatcatttcaccaattcatacatatgttgcacttttagtgtggctcggtgctgttcattttatcggaattattaatgtcaccaccttcttattgctcccctttcacaaatacctcctggtagtgggaatatttgtggtcttgatgttcatccccattaatgaggacagtaaatggggcttagctttagccaggtacatatataagcatgggggtggtcatttccctgcttctgtatatgttgaagatattaaagcattcaatcctgatcagacttacgtttttggatacgaaccccattcggtttgtccatttggagctggggcaatatcacatttcaccggttttttgcctacaggcaaagtcaagatccttgcaagtaccgctgtgttcttaacgccgttcatgaggcatatatggacatggatgggagtgtcaccggcaacaagggaaaacttcaagtctcttttaaaaaacggttatagttgcgtagttgtcccaggtggagtacgtgaggtcttttacatggagcctaattcagaggttgcctttttaaaagcaagaaaagggttcatacgtctcgcaatggagactggttctcccttggtccctgttttcgcctttgggcagtcagctgcttaccagtattggaggccaaagggggaactttatctgaaactgacccgagctgtcaagttcacgcctatatttttcgggggtaaattttggtctcctataccgtttcgacgacctgttcttgtggtggtcggtaagccaatacaagtgaagaagagttctactcccactatggaagaggttaatgaagtacatgatgagtttgtgaaagcacttaaagagttatttgatacgcataaagcacgagcaggatatcctgatatggagttacgtgtgatgtgagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacggatccgtcgacgg

SEQ ID NO: 60 - DNA, 10875 bp, Artificial Sequence
  vector
cgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttactgcaacttccttgccttctccttggcagcgtcggccttggcctgcttggccaacttggcgttctttctgtaaaagttgtagaagagaccgagcatggtccacatgtagaaccaaagcagagccgtgatgaagaaggggtatccggggcggccaaggaccttcatggcgtacatgtcccaggaagactggaccgacatcatgcagaactgtgtcatctgcgagcgcgtgatgtagaacttgatgaacgacacctgcttgaagcccaaggccgacaagaagtagtagccgtacatgatcacatggatgaacgagttcaacgcagcagagaagtaggcttcaccgttgggtgcaacaaaggtgaccaaccaccagatggtgaagatggagctgtggtggtaaacgtgcaagaaggagatctggcggttgttcttcttgaggaccatgatcatggtgtcgacaaactccatgatcttggagaagtagaagagccagatcatcttggccataggaagacccttgaaggtatgatcagcagcgttctcaaacagtccatagttggcctgataagcctcgtacaggatcccaccgcacatgtaggcgctgatcgagaccagacaaaagttgtgcaggagcgaaaacgtcttgacctcgaaccgctcaaagttcttcatgatctgcatgcccacaaagaccgtgaccaaataagcgagcacgatcaacagcacgtggaacgggttcatcaacggcagctcacgggccaaaggcgactccaccgcgaccaggaacccacgcgtgtgatggacaatcgtggggatgtacttctcggcctgggccaccagcgcggcctcgagaggatcgacatagggcgcggcccggacaccgatagcggtggcaaggtccataaacagatcttgcggcatctttgatgggaggaatggcgcaatcgactccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaaaccatggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctacctccaagatgggtaaggcgcagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 61 - DNA, 12118 bp, Artificial Sequence
  vector
  misc_feature (9329)..(9329): n is a, c, g, or t
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcttactgcgccttacccatcttggaggtagccttggagacctcgttcagacggctaaagacctctgcagttccctcgatcataccggtggtgtggtatcggacattgtactttttgcacagggtctcgacagcaggctggatctttgaaaagttgtggcgaggcatcgaagggaacaagtggtgctcgatctgatagttcaatccacccgtgaaccagttggcaaatagacccgggtggacatcacgacccgtgatgatctgcttcgtgaagaaatccatatcgaccgcctcctccttcgagatcacaggcataccgttgtggttgagcgagaacacgatcgccaacaagtttccgcacaccgcctgcgacaccaaaaagtacaccagcatgttgacgggatccttgatgaacaggaacatggtggcgaggtaccaggtccagtgcatcgcaagcgacagctgctcgaccaacgagatgggcacacgcgcgcccgagggcttgtgggcctgaccgttaggcagcacaaagagaatggactggaggcaccaggagagacgggcaaacgagagaatggggaagtaaaaccaggtctggttcaggaccatgaaacgcgaccacatgcgggtcagctcctcatctgggacatccgagaacatctccaacgcatgctcactccaggtcaacagagggtgggtgtcaatgtcgggatcctcgccgtggacgttgggggcggcgtggtgagtgttgtgcttgtccttccaccacgaggacgagaagccctggcagacacctcccaagaaggcgccgaaaagatcaccccagaaacggtcctggaagacctggtgatgcaaaaagtcgtgagccaaccatccgcactgctgccagaacagacccaaaagcgcagccgagagcacgttggcgagggtcgaggtctggccccacttggccacaatgaccgtcgacaaaccccagatgcagaggttgaacgagaccttgaaggcgtagtatgccttggaagaatcgtagtaaccaagagactggaacaaggtacgcagcttgcggacctcggccgcaaagtcatcattcttgatatcgcggtcgctctcgtcaatatcaccaacgtaaaagttggcaagagtctcccaagcagcctcggggtgaaaagtgtcaaagacgtcagtgccgtccttgccaacgtgcgtgagaatcacacttccaccgggatgatcagggacgaactcgcggacatcgtacaccttgttgtcgatgatcatcaagaagggtgcctcggcatccttcttgccctcattcagagcctcggcattcaaaacctcggcccgagtaaacgtcctcacactgggagcagcagccatggtttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatggagtcgattgcgccattcctcccatcaaagatgccgcaagatctgtttatggaccttgccaccgctatcggtgtccgggccgcgccctatgtcgatcctctcgaggccgcgctggtggcccaggccgagaagtacatccccacgattgtccatcacacgcgtgggttcctggtcgcggtggagtcgcctttggcccgtgagctgccgttgatgaacccgttccacgtgctgttgatcgtgctcgcttatttggtcacggtctttgtgggcatgcagatcatgaagaactttgagcggttcgaggtcaagacgttttcgctcctgcacaacttttgtctggtctcgatcagcgcctacatgtgcggtgggatcctgtacgaggcttatcaggccaactatggactgtttgagaacgctgctgatcataccttcaagggtcttcctatggccaagatgatctggctcttctacttctccaagatcatggagtttgtcgacaccatgatcatggtcctcaagaagaacaaccgccagatctccttcttgcacgtttaccaccacagctccatcttcaccatctggtggttggtcacctttgttgcacccaacggtgaagcctacttctctgctgcgttgaactcgttcatccatgtgatcatgtacggctactacttcttgtcggccttgggcttcaagcaggtgtcgttcatcaagttctacatcacgcgctcgcagatgacacagttctgcatgatgtcggtccagtcttcctgggacatgtacgccatgaaggtccttggccgccccggataccccttcttcatcacggctctgctttggttctacatgtggaccatgctcggtctcttctacaacttttacagaaagaacgccaagttggccaagcaggccaaggccgacgctgccaaggagaaggcaaggaagttgcagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtgagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 62 - DNA, 14844 bp, Artificial Sequence
  vector
  misc_feature (8052)..(8052): n is a, c, g, or t
cgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttactgcaacttccttgccttctccttggcagcgtcggccttggcctgcttggccaacttggcgttctttctgtaaaagttgtagaagagaccgagcatggtccacatgtagaaccaaagcagagccgtgatgaagaaggggtatccggggcggccaaggaccttcatggcgtacatgtcccaggaagactggaccgacatcatgcagaactgtgtcatctgcgagcgcgtgatgtagaacttgatgaacgacacctgcttgaagcccaaggccgacaagaagtagtagccgtacatgatcacatggatgaacgagttcaacgcagcagagaagtaggcttcaccgttgggtgcaacaaaggtgaccaaccaccagatggtgaagatggagctgtggtggtaaacgtgcaagaaggagatctggcggttgttcttcttgaggaccatgatcatggtgtcgacaaactccatgatcttggagaagtagaagagccagatcatcttggccataggaagacccttgaaggtatgatcagcagcgttctcaaacagtccatagttggcctgataagcctcgtacaggatcccaccgcacatgtaggcgctgatcgagaccagacaaaagttgtgcaggagcgaaaacgtcttgacctcgaaccgctcaaagttcttcatgatctgcatgcccacaaagaccgtgaccaaataagcgagcacgatcaacagcacgtggaacgggttcatcaacggcagctcacgggccaaaggcgactccaccgcgaccaggaacccacgcgtgtgatggacaatcgtggggatgtacttctcggcctgggccaccagcgcggcctcgagaggatcgacatagggcgcggcccggacaccgatagcggtggcaaggtccataaacagatcttgcggcatctttgatgggaggaatggcgcaatcgactccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaaaccatggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctacctccaagatgggtaaggcgcagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 63 - DNA, 12109 bp, Artificial Sequence
  vector
  misc_feature (9329)..(9329): n is a, c, g, or t
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcttactgcgccttacccatcttggaggtagccttggagacctcgttcagacggctaaagacctctgcagttccctcgatcataccggtggtgtggtatcggacattgtactttttgcacagggtctcgacagcaggctggatctttgaaaagttgtggcgaggcatcgaagggaacaagtggtgctcgatctgatagttcaatccacccgtgaaccagttggcaaatagacccgggtggacatcacgacccgtgatgatctgcttcgtgaagaaatccatatcgaccgcctcctccttcgagatcacaggcataccgttgtggttgagcgagaacacgatcgccaacaagtttccgcacaccgcctgcgacaccaaaaagtacaccagcatgttgacgggatccttgatgaacaggaacatggtggcgaggtaccaggtccagtgcatcgcaagcgacagctgctcgaccaacgagatgggcacacgcgcgcccgagggcttgtgggcctgaccgttaggcagcacaaagagaatggactggaggcaccaggagagacgggcaaacgagagaatggggaagtaaaaccaggtctggttcaggaccatgaaacgcgaccacatgcgggtcagctcctcatctgggacatccgagaacatctccaacgcatgctcactccaggtcaacagagggtgggtgtcaatgtcgggatcctcgccgtggacgttgggggcggcgtggtgagtgttgtgcttgtccttccaccacgaggacgagaagccctggcagacacctcccaagaaggcgccgaaaagatcaccccagaaacggtcctggaagacctggtgatgcaaaaagtcgtgagccaaccatccgcactgctgccagaacagacccaaaagcgcagccgagagcacgttggcgagggtcgaggtctggccccacttggccacaatgaccgtcgacaaaccccagatgcagaggttgaacgagaccttgaaggcgtagtatgccttggaagaatcgtagtaaccaagagactggaacaaggtacgcagcttgcggacctcggccgcaaagtcatcattcttgatatcgcggtcgctctcgtcaatatcaccaacgtaaaagttggcaagagtctcccaagcagcctcggggtgaaaagtgtcaaagacgtcagtgccgtccttgccaacgtgcgtgagaatcacacttccaccgggatgatcagggacgaactcgcggacatcgtacaccttgttgtcgatgatcatcaagaagggtgcctcggcatccttcttgccctcattcagagcctcggcattcaaaacctcggcccgagtaaacgtcctcacactgggagcagcagccatggtttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatggagtcgattgcgccattcctcccatcaaagatgccgcaagatctgtttatggaccttgccaccgctatcggtgtccgggccgcgccctatgtcgatcctctcgaggccgcgctggtggcccaggccgagaagtacatccccacgattgtccatcacacgcgtgggttcctggtcgcggtggagtcgcctttggcccgtgagctgccgttgatgaacccgttccacgtgctgttgatcgtgctcgcttatttggtcacggtctttgtgggcatgcagatcatgaagaactttgagcggttcgaggtcaagacgttttcgctcctgcacaacttttgtctggtctcgatcagcgcctacatgtgcggtgggatcctgtacgaggcttatcaggccaactatggactgtttgagaacgctgctgatcataccttcaagggtcttcctatggccaagatgatctggctcttctacttctccaagatcatggagtttgtcgacaccatgatcatggtcctcaagaagaacaaccgccagatctccttcttgcacgtttaccaccacagctccatcttcaccatctggtggttggtcacctttgttgcacccaacggtgaagcctacttctctgctgcgttgaactcgttcatccatgtgatcatgtacggctactacttcttgtcggccttgggcttcaagcaggtgtcgttcatcaagttctacatcacgcgctcgcagatgacacagttctgcatgatgtcggtccagtcttcctgggacatgtacgccatgaaggtccttggccgccccggataccccttcttcatcacggctctgctttggttctacatgtggaccatgctcggtctcttctacaacttttacagaaagaacgccaagttggccaagcaggccaaggccgacgctgccaaggagaaggcaaggaagttgcagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtcaatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatgagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 64 - DNA, 14835 bp, Artificial Sequence
  vector
  misc_feature (8043)..(8043): n is a, c, g, or t
cgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcattgatcttttcgtgctttagatctaacaggctttgttttgattacattaccaagaaggattaaaaccacaggaataatagttccaatgtagtatacactcccgtatgcagtcactgtttcgtgtaggcttaataccatgaaaccaacacatgagtagttgagaacgagaagtgtataagcgaagtttacaagcataaaaatcttcttaagcaaccccaaatttgggggaacagattgctgccatctgtaaatggctcttgaaccagcaatcatcaaagctgattgaacaaaaaatatgatgtaccctggatataatccatgccatacagcactaacagtctgtgttgcaagcaattggaagaaaccagcctttttcccctttttaacaagtctgtcataaacatagtgacgaagccatgtgctgacttgaatattccatacaagtggtatctccactgcactcctagcaaactcaacacccaaaacatcaacatttttagcccggtcccaccgggccttgggtggagaagaatcggcccacccactaaagcccaaaccagaaataacaatagaagcttctgaaatggaccatatgaaataatatttccaacgggccgtaaagcccgccatgtattggtaactcaatcgtttccagaatccccattctttatatatcgggtcagtgaattttgataacgggtaatgaggtaccaaatataagtacaaacccatacagacaccagcttgaacaagagctttgacggttggcccgaaaggtgatggtgaacccttttccgactttatccagatccctttgccttctgtccaatctaagtaatccttaatttcataaactgggcctgcaaaatgacttccacaacaaagacaaaatcccacatactcgattaaagaaggcagcttaagtaactgatttttcttctgggattcgcgaagatcttcatcttttagtaatccatcattgtaattaatcgcgcacgaaataacttttaatgttattaccataagagctccagtagcatcaatacctccttccttccatgcatccccactcatgtagtatacatggcatccaatgaggtatcccatagctaacacgaatgtaattaagccgcatcgtttccgatagaccaccattgacacgtaactgaccaacataggcacgagaaagtgtagatttgaagagaaaccaaaggataagtaagagagtacaacgccggtagaggcggcgtacaagtgttttccggtggggccgccggggatgaggcgatggaaaaagccggcaggaatagtggcgacgaagcatagaaggaatcggagtaccggcaccgatactccgatagccgtcgccgttgattccatatccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttactgcaacttccttgccttctccttggcagcgtcggccttggcctgcttggccaacttggcgttctttctgtaaaagttgtagaagagaccgagcatggtccacatgtagaaccaaagcagagccgtgatgaagaaggggtatccggggcggccaaggaccttcatggcgtacatgtcccaggaagactggaccgacatcatgcagaactgtgtcatctgcgagcgcgtgatgtagaacttgatgaacgacacctgcttgaagcccaaggccgacaagaagtagtagccgtacatgatcacatggatgaacgagttcaacgcagcagagaagtaggcttcaccgttgggtgcaacaaaggtgaccaaccaccagatggtgaagatggagctgtggtggtaaacgtgcaagaaggagatctggcggttgttcttcttgaggaccatgatcatggtgtcgacaaactccatgatcttggagaagtagaagagccagatcatcttggccataggaagacccttgaaggtatgatcagcagcgttctcaaacagtccatagttggcctgataagcctcgtacaggatcccaccgcacatgtaggcgctgatcgagaccagacaaaagttgtgcaggagcgaaaacgtcttgacctcgaaccgctcaaagttcttcatgatctgcatgcccacaaagaccgtgaccaaataagcgagcacgatcaacagcacgtggaacgggttcatcaacggcagctcacgggccaaaggcgactccaccgcgaccaggaacccacgcgtgtgatggacaatcgtggggatgtacttctcggcctgggccaccagcgcggcctcgagaggatcgacatagggcgcggcccggacaccgatagcggtggcaaggtccataaacagatcttgcggcatctttgatgggaggaatggcgcaatcgactccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaaaccatggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctacctccaagatgggtaaggcgcagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 65 - DNA, 10634 bp, Artificial Sequence
  vector
cgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcagcccgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 66 - DNA, 11828 bp, Artificial Sequence
  vector
  misc_feature (9039)..(9039): n is a, c, g, or t
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcactgaatctttttggctcccttgtgcttcctgacgatatacgtttgcacatagaaattcaagaacaaacacaagactgtgccaacataaaagtaattgaagaaccagccaaacatcctcatcccatcttggcgataacagggaatgttcctgtacttccagacaatgtagaaaccaacattgaattgaatgatctgcattgatgtaatcagggattttggcatggggaacttcagcttgatcaatctggtccaataataaccgtacatgatccagtggatgaaaccattcaacagcacaaaaatccaaacagcttcatttcggtaattatagaacagccacatatccatcggtgcccccaaatgatggaagaattgcaaccaggtcagaggcttgcccatcagtggcaaatagaaggagtcaatatactccaggaacttgctcaaatagaacaactgcgtggtgatcctgaagacgttgttgtcaaaagccttctcgcagttgtcagacataacaccgatggtgtacatggcatatgccattgagaggaatgatcccaacgaataaatggacatgagaaggttgtaattggtgaaaacaaacttcatacgagactgaccttttggaccaagggggccaagagtgaacttcaagatgacaaatgcgatggacaagtaaagcacctcacagtgactggcatcactccagagttgggcataatcaactttgggtaaaacttcctgcccaattgagactatttcattcaccacctccatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtgagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 67 - DNA, 14554 bp, Artificial Sequence
  vector
  misc_feature (8052)..(8052): n is a, c, g, or t
cgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 68 - DNA, 11819 bp, Artificial Sequence
  vector
  misc_feature (9039)..(9039): n is a, c, g, or t
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcactgaatctttttggctcccttgtgcttcctgacgatatacgtttgcacatagaaattcaagaacaaacacaagactgtgccaacataaaagtaattgaagaaccagccaaacatcctcatcccatcttggcgataacagggaatgttcctgtacttccagacaatgtagaaaccaacattgaattgaatgatctgcattgatgtaatcagggattttggcatggggaacttcagcttgatcaatctggtccaataataaccgtacatgatccagtggatgaaaccattcaacagcacaaaaatccaaacagcttcatttcggtaattatagaacagccacatatccatcggtgcccccaaatgatggaagaattgcaaccaggtcagaggcttgcccatcagtggcaaatagaaggagtcaatatactccaggaacttgctcaaatagaacaactgcgtggtgatcctgaagacgttgttgtcaaaagccttctcgcagttgtcagacataacaccgatggtgtacatggcatatgccattgagaggaatgatcccaacgaataaatggacatgagaaggttgtaattggtgaaaacaaacttcatacgagactgaccttttggaccaagggggccaagagtgaacttcaagatgacaaatgcgatggacaagtaaagcacctcacagtgactggcatcactccagagttgggcataatcaactttgggtaaaacttcctgcccaattgagactatttcattcaccacctccatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtcaatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatgagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 69 - DNA, 14545 bp, Artificial Sequence
  vector
  misc_feature (8043)..(8043): n is a, c, g, or t
cgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcattgatcttttcgtgctttagatctaacaggctttgttttgattacattaccaagaaggattaaaaccacaggaataatagttccaatgtagtatacactcccgtatgcagtcactgtttcgtgtaggcttaataccatgaaaccaacacatgagtagttgagaacgagaagtgtataagcgaagtttacaagcataaaaatcttcttaagcaaccccaaatttgggggaacagattgctgccatctgtaaatggctcttgaaccagcaatcatcaaagctgattgaacaaaaaatatgatgtaccctggatataatccatgccatacagcactaacagtctgtgttgcaagcaattggaagaaaccagcctttttcccctttttaacaagtctgtcataaacatagtgacgaagccatgtgctgacttgaatattccatacaagtggtatctccactgcactcctagcaaactcaacacccaaaacatcaacatttttagcccggtcccaccgggccttgggtggagaagaatcggcccacccactaaagcccaaaccagaaataacaatagaagcttctgaaatggaccatatgaaataatatttccaacgggccgtaaagcccgccatgtattggtaactcaatcgtttccagaatccccattctttatatatcgggtcagtgaattttgataacgggtaatgaggtaccaaatataagtacaaacccatacagacaccagcttgaacaagagctttgacggttggcccgaaaggtgatggtgaacccttttccgactttatccagatccctttgccttctgtccaatctaagtaatccttaatttcataaactgggcctgcaaaatgacttccacaacaaagacaaaatcccacatactcgattaaagaaggcagcttaagtaactgatttttcttctgggattcgcgaagatcttcatcttttagtaatccatcattgtaattaatcgcgcacgaaataacttttaatgttattaccataagagctccagtagcatcaatacctccttccttccatgcatccccactcatgtagtatacatggcatccaatgaggtatcccatagctaacacgaatgtaattaagccgcatcgtttccgatagaccaccattgacacgtaactgaccaacataggcacgagaaagtgtagatttgaagagaaaccaaaggataagtaagagagtacaacgccggtagaggcggcgtacaagtgttttccggtggggccgccggggatgaggcgatggaaaaagccggcaggaatagtggcgacgaagcatagaaggaatcggagtaccggcaccgatactccgatagccgtcgccgttgattccatatccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 70 - DNA, 18903 bp, Artificial Sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttactgcaacttccttgccttctccttggcagcgtcggccttggcctgcttggccaacttggcgttctttctgtaaaagttgtagaagagaccgagcatggtccacatgtagaaccaaagcagagccgtgatgaagaaggggtatccggggcggccaaggaccttcatggcgtacatgtcccaggaagactggaccgacatcatgcagaactgtgtcatctgcgagcgcgtgatgtagaacttgatgaacgacacctgcttgaagcccaaggccgacaagaagtagtagccgtacatgatcacatggatgaacgagttcaacgcagcagagaagtaggcttcaccgttgggtgcaacaaaggtgaccaaccaccagatggtgaagatggagctgtggtggtaaacgtgcaagaaggagatctggcggttgttcttcttgaggaccatgatcatggtgtcgacaaactccatgatcttggagaagtagaagagccagatcatcttggccataggaagacccttgaaggtatgatcagcagcgttctcaaacagtccatagttggcctgataagcctcgtacaggatcccaccgcacatgtaggcgctgatcgagaccagacaaaagttgtgcaggagcgaaaacgtcttgacctcgaaccgctcaaagttcttcatgatctgcatgcccacaaagaccgtgaccaaataagcgagcacgatcaacagcacgtggaacgggttcatcaacggcagctcacgggccaaaggcgactccaccgcgaccaggaacccacgcgtgtgatggacaatcgtggggatgtacttctcggcctgggccaccagcgcggcctcgagaggatcgacatagggcgcggcccggacaccgatagcggtggcaaggtccataaacagatcttgcggcatctttgatgggaggaatggcgcaatcgactccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaaaccatggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctacctccaagatgggtaaggcgcagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 71 - DNA, 22872 bp, Artificial Sequence
  vector
  misc_feature (16080)..(16080): n is a, c, g, or t
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttactgcaacttccttgccttctccttggcagcgtcggccttggcctgcttggccaacttggcgttctttctgtaaaagttgtagaagagaccgagcatggtccacatgtagaaccaaagcagagccgtgatgaagaaggggtatccggggcggccaaggaccttcatggcgtacatgtcccaggaagactggaccgacatcatgcagaactgtgtcatctgcgagcgcgtgatgtagaacttgatgaacgacacctgcttgaagcccaaggccgacaagaagtagtagccgtacatgatcacatggatgaacgagttcaacgcagcagagaagtaggcttcaccgttgggtgcaacaaaggtgaccaaccaccagatggtgaagatggagctgtggtggtaaacgtgcaagaaggagatctggcggttgttcttcttgaggaccatgatcatggtgtcgacaaactccatgatcttggagaagtagaagagccagatcatcttggccataggaagacccttgaaggtatgatcagcagcgttctcaaacagtccatagttggcctgataagcctcgtacaggatcccaccgcacatgtaggcgctgatcgagaccagacaaaagttgtgcaggagcgaaaacgtcttgacctcgaaccgctcaaagttcttcatgatctgcatgcccacaaagaccgtgaccaaataagcgagcacgatcaacagcacgtggaacgggttcatcaacggcagctcacgggccaaaggcgactccaccgcgaccaggaacccacgcgtgtgatggacaatcgtggggatgtacttctcggcctgggccaccagcgcggcctcgagaggatcgacatagggcgcggcccggacaccgatagcggtggcaaggtccataaacagatcttgcggcatctttgatgggaggaatggcgcaatcgactccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaaaccatggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctacctccaagatgggtaaggcgcagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 72 - DNA, 22863 bp, Artificial Sequence
  vector
  misc_feature (16071)..(16071): n is a, c, g, or t
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcattgatcttttcgtgctttagatctaacaggctttgttttgattacattaccaagaaggattaaaaccacaggaataatagttccaatgtagtatacactcccgtatgcagtcactgtttcgtgtaggcttaataccatgaaaccaacacatgagtagttgagaacgagaagtgtataagcgaagtttacaagcataaaaatcttcttaagcaaccccaaatttgggggaacagattgctgccatctgtaaatggctcttgaaccagcaatcatcaaagctgattgaacaaaaaatatgatgtaccctggatataatccatgccatacagcactaacagtctgtgttgcaagcaattggaagaaaccagcctttttcccctttttaacaagtctgtcataaacatagtgacgaagccatgtgctgacttgaatattccatacaagtggtatctccactgcactcctagcaaactcaacacccaaaacatcaacatttttagcccggtcccaccgggccttgggtggagaagaatcggcccacccactaaagcccaaaccagaaataacaatagaagcttctgaaatggaccatatgaaataatatttccaacgggccgtaaagcccgccatgtattggtaactcaatcgtttccagaatccccattctttatatatcgggtcagtgaattttgataacgggtaatgaggtaccaaatataagtacaaacccatacagacaccagcttgaacaagagctttgacggttggcccgaaaggtgatggtgaacccttttccgactttatccagatccctttgccttctgtccaatctaagtaatccttaatttcataaactgggcctgcaaaatgacttccacaacaaagacaaaatcccacatactcgattaaagaaggcagcttaagtaactgatttttcttctgggattcgcgaagatcttcatcttttagtaatccatcattgtaattaatcgcgcacgaaataacttttaatgttattaccataagagctccagtagcatcaatacctccttccttccatgcatccccactcatgtagtatacatggcatccaatgaggtatcccatagctaacacgaatgtaattaagccgcatcgtttccgatagaccaccattgacacgtaactgaccaacataggcacgagaaagtgtagatttgaagagaaaccaaaggataagtaagagagtacaacgccggtagaggcggcgtacaagtgttttccggtggggccgccggggatgaggcgatggaaaaagccggcaggaatagtggcgacgaagcatagaaggaatcggagtaccggcaccgatactccgatagccgtcgccgttgattccatatccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttactgcaacttccttgccttctccttggcagcgtcggccttggcctgcttggccaacttggcgttctttctgtaaaagttgtagaagagaccgagcatggtccacatgtagaaccaaagcagagccgtgatgaagaaggggtatccggggcggccaaggaccttcatggcgtacatgtcccaggaagactggaccgacatcatgcagaactgtgtcatctgcgagcgcgtgatgtagaacttgatgaacgacacctgcttgaagcccaaggccgacaagaagtagtagccgtacatgatcacatggatgaacgagttcaacgcagcagagaagtaggcttcaccgttgggtgcaacaaaggtgaccaaccaccagatggtgaagatggagctgtggtggtaaacgtgcaagaaggagatctggcggttgttcttcttgaggaccatgatcatggtgtcgacaaactccatgatcttggagaagtagaagagccagatcatcttggccataggaagacccttgaaggtatgatcagcagcgttctcaaacagtccatagttggcctgataagcctcgtacaggatcccaccgcacatgtaggcgctgatcgagaccagacaaaagttgtgcaggagcgaaaacgtcttgacctcgaaccgctcaaagttcttcatgatctgcatgcccacaaagaccgtgaccaaataagcgagcacgatcaacagcacgtggaacgggttcatcaacggcagctcacgggccaaaggcgactccaccgcgaccaggaacccacgcgtgtgatggacaatcgtggggatgtacttctcggcctgggccaccagcgcggcctcgagaggatcgacatagggcgcggcccggacaccgatagcggtggcaaggtccataaacagatcttgcggcatctttgatgggaggaatggcgcaatcgactccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaaaccatggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctacctccaagatgggtaaggcgcagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 73 - DNA, 18662 bp, Artificial Sequence
  vector
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcactgaatctttttggctcccttgtgcttcctgacgatatacgtttgcacatagaaattcaagaacaaacacaagactgtgccaacataaaagtaattgaagaaccagccaaacatcctcatcccatcttggcgataacagggaatgttcctgtacttccagacaatgtagaaaccaacattgaattgaatgatctgcattgatgtaatcagggattttggcatggggaacttcagcttgatcaatctggtccaataataaccgtacatgatccagtggatgaaaccattcaacagcacaaaaatccaaacagcttcatttcggtaattatagaacagccacatatccatcggtgcccccaaatgatggaagaattgcaaccaggtcagaggcttgcccatcagtggcaaatagaaggagtcaatatactccaggaacttgctcaaatagaacaactgcgtggtgatcctgaagacgttgttgtcaaaagccttctcgcagttgtcagacataacaccgatggtgtacatggcatatgccattgagaggaatgatcccaacgaataaatggacatgagaaggttgtaattggtgaaaacaaacttcatacgagactgaccttttggaccaagggggccaagagtgaacttcaagatgacaaatgcgatggacaagtaaagcacctcacagtgactggcatcactccagagttgggcataatcaactttgggtaaaacttcctgcccaattgagactatttcattcaccacctccatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggatctggccggccggatctcgtacggatccgtcgacgg

SEQ ID NO: 74 - DNA, 22582 bp, Artificial Sequence
  vector
  misc_feature (16080)..(16080): n is a, c, g, or t
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 75 - DNA, 22573 bp, Artificial Sequence
  vector
  misc_feature (16071)..(16071): n is a, c, g, or t
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcattgatcttttcgtgctttagatctaacaggctttgttttgattacattaccaagaaggattaaaaccacaggaataatagttccaatgtagtatacactcccgtatgcagtcactgtttcgtgtaggcttaataccatgaaaccaacacatgagtagttgagaacgagaagtgtataagcgaagtttacaagcataaaaatcttcttaagcaaccccaaatttgggggaacagattgctgccatctgtaaatggctcttgaaccagcaatcatcaaagctgattgaacaaaaaatatgatgtaccctggatataatccatgccatacagcactaacagtctgtgttgcaagcaattggaagaaaccagcctttttcccctttttaacaagtctgtcataaacatagtgacgaagccatgtgctgacttgaatattccatacaagtggtatctccactgcactcctagcaaactcaacacccaaaacatcaacatttttagcccggtcccaccgggccttgggtggagaagaatcggcccacccactaaagcccaaaccagaaataacaatagaagcttctgaaatggaccatatgaaataatatttccaacgggccgtaaagcccgccatgtattggtaactcaatcgtttccagaatccccattctttatatatcgggtcagtgaattttgataacgggtaatgaggtaccaaatataagtacaaacccatacagacaccagcttgaacaagagctttgacggttggcccgaaaggtgatggtgaacccttttccgactttatccagatccctttgccttctgtccaatctaagtaatccttaatttcataaactgggcctgcaaaatgacttccacaacaaagacaaaatcccacatactcgattaaagaaggcagcttaagtaactgatttttcttctgggattcgcgaagatcttcatcttttagtaatccatcattgtaattaatcgcgcacgaaataacttttaatgttattaccataagagctccagtagcatcaatacctccttccttccatgcatccccactcatgtagtatacatggcatccaatgaggtatcccatagctaacacgaatgtaattaagccgcatcgtttccgatagaccaccattgacacgtaactgaccaacataggcacgagaaagtgtagatttgaagagaaaccaaaggataagtaagagagtacaacgccggtagaggcggcgtacaagtgttttccggtggggccgccggggatgaggcgatggaaaaagccggcaggaatagtggcgacgaagcatagaaggaatcggagtaccggcaccgatactccgatagccgtcgccgttgattccatatccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 76 - DNA, 4538 bp, Artificial Sequence
  vector
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatgtcgaagacggaggagacaaatggattaatcctgccaccaccaccagcagcagcagaaccaccaacaccggcgttgttcacaagtaaaatcatttcaccaattcatacatatgttgcacttttagtgtggctcggtgctgttcattttatcggaattattaatgtcaccaccttcttattgctcccctttcacaaatacctcctggtagtgggaatatttgtggtcttgatgttcatccccattaatgaggacagtaaatggggcttagctttagccaggtacatatataagcatgggggtggtcatttccctgcttctgtatatgttgaagatattaaagcattcaatcctgatcagacttacgtttttggatacgaaccccattcggtttgtccatttggagctggggcaatatcacatttcaccggttttttgcctacaggcaaagtcaagatccttgcaagtaccgctgtgttcttaacgccgttcatgaggcatatatggacatggatgggagtgtcaccggcaacaagggaaaacttcaagtctcttttaaaaaacggttatagttgcgtagttgtcccaggtggagtacgtgaggtcttttacatggagcctaattcagaggttgcctttttaaaagcaagaaaagggttcatacgtctcgcaatggagactggttctcccttggtccctgttttcgcctttgggcagtcagctgcttaccagtattggaggccaaagggggaactttatctgaaactgacccgagctgtcaagttcacgcctatatttttcgggggtaaattttggtctcctataccgtttcgacgacctgttcttgtggtggtcggtaagccaatacaagtgaagaagagttctactcccactatggaagaggttaatgaagtacatgatgagtttgtgaaagcacttaaagagttatttgatacgcataaagcacgagcaggatatcctgatatggagttacgtgtgatgtgagcggccgct

SEQ ID NO: 77 - DNA, 1149 bp, Vernonia galamensis
atgggagcaggagggtgcatgtctgcctccgagacaaaaacacaacaaaagaaccctatcgagcgagtcccttatgcaaaacctcctttcaccatcagcgacctcaaaaaagccattcctccccactgtttccagcgttcccttatccgttccttctcttatgtcgtttatgaccttgctgtgagcttcctcctctactatgtagccgccacttacttccaccatctgccaaaccctttctcctcccttgcgtggctggcttattgggtcgttcaaggctgtgtgcttacaggagtgtgggtcatagcccatgaatgtggtcaccatgcatttagtgactatcaatgggttgatgacactgtgggcttcctactccactcggttctacttgttcctttcttttcatggaaatacagtcatcgtcgacaccactccaacaccggatcactcgagcgtgatgaagtctttgtcccaaaaccgagatcgaaaatcccttggtactcaaaatactttaacaacgcacctggccgcatgatgagtgtgttcaccaccctaactctaggctggcccttgtacttggttttcaatgtatcagggagaccctatgaccgttttgcctgccacttttctcctaacagccctatatacaacgaacgtgagcgtctccaaatatggctttcggatttagggatgatcaccatgtcgttcatcctttatcgtgttgctgtagcaaaaggtgtggcttgggtaatatgcatgtatgggatcccgctactgattgtgaacggattcctggtgacgatcacgtaccttcaacacactcacccttcattgccccactatgatagctcagagtgggactggctaaggggagcaatggcaacggtggaccgtgactatggtgtgctcaacaaggtattccataacatcacagatacacacgtggtgcaccatttgttctcgacgatgcctcattataacgcaatggaggcaacgaaagcagtgaagcctttgcttggggagtattatcagtttgacgggactccgttttacgtagcaatatggagagaggcaaaggagtgtctgttcgtggatccagatgagggggagggtcagggaggtgtgttttggtacaagaataagatgtga

SEQ ID NO: 78 - protein, 382 aa, Vernonia galamensis
MGAGGCMSASETKTQQKNPIERVPYAKPPFTISDLKKAIPPHCFQRSLIRSFSYVVYDLAVSFLLYYVAATYFHHLPNPFSSLAWLAYWVVQGCVLTGVWVIAHECGHHAFSDYQWVDDTVGFLLHSVLLVPFFSWKYSHRRHHSNTGSLERDEVFVPKPRSKIPWYSKYFNNAPGRMMSVFTTLTLGWPLYLVFNVSGRPYDRFACHFSPNSPIYNERERLQIWLSDLGMITMSFILYRVAVAKGVAWVICMYGIPLLIVNGFLVTITYLQHTHPSLPHYDSSEWDWLRGAMATVDRDYGVLNKVFHNITDTHVVHHLFSTMPHYNAMEATKAVKPLLGEYYQFDGTPFYVAIWREAKECLFVDPDEGEGQGGVFWYKNKM

SEQ ID NO: 79 - DNA, 1155 bp, Vernonia galamensis
atgatgatgtcggattcatgtgatgatcatgatcagctggtgaaagatgatcataatataaacgaacgtgcaccggttgatgcggcaccattctcgttaagcgatctaaagaaagcaatccctccgcattgcttccagcgatctgccatccgttcatcgtgctacgttgttcaggatctcattattaccttccttttatacacgctcgccaactcttacattcctcttcttcctcctcctctaccttacttagcatggcctgtttactggttttgccaatcttcgatcctcactggtttatgggtcattggccatgaatgtggccatcatgcttatagtgagtaccagtgggttgataacaccgttggattcatcctccattcctttcttctcacaccttacttttcttggaaatacagccatcgaaagcaccatgccaacacgaattcactcgaaaacgaggaggtttacattcctaaagccaagtcccagctcaggaattactccaatttcaaatttcttgacaacacccctggtcgaatcttcattttgcttatcatgttgaccttgggctttcctttatacctcttgaccaatatttcaggcaagaaataccaaaggtttgccaaccactttgatccgttgagccccatcttcagtgagcgtgaacgaatccaggtcgtgctatcggatgtgggtctcattgctgtgttttacgggcttaagtttcttgtagcgaaaaaagggttcggttgggtaatgcgcatgtacggagccccagtggttgggctgaatgccttcataataatgatcacttatctccaccacacccatctgtcttcgcctcattacgattcgaccgaatggaactggatcaaaggagccttgactacaatcgatagagatttcggtctcctgaatagggtgttccatgacgtcactcacacacacgtgttgcatcatttgttcccgtacattccacattatcatgcaaaggaggcgagcgacgcaataaagccggtgttaggggagtatcggatgatcgataggactccgttttacaaagcaatgtggagagaggcgaaggaatgcatctacatcgagccagatgaagataagaagcacaaaggtgtatattggtaccataaaatgtga

SEQ ID NO: 80 - protein, 384 aa, Vernonia galamensis
MMMSDSCDDHDQLVKDDHNINERAPVDAAPFSLSDLKKAIPPHCFQRSAIRSSCYVVQDLIITFLLYTLANSYIPLLPPPLPYLAWPVYWFCQSSILTGLWVIGHECGHHAYSEYQWVDNTVGFILHSFLLTPYFSWKYSHRKHHANTNSLENEEVYIPKAKSQLRNYSNFKFLDNTPGRIFILLIMLTLGFPLYLLTNISGKKYQRFANHFDPLSPIFSERERIQVVLSDVGLIAVFYGLKFLVAKKGFGWVMRMYGAPVVGLNAFIIMITYLHHTHLSSPHYDSTEWNWIKGALTTIDRDFGLLNRVFHDVTHTHVLHHLFPYIPHYHAKEASDAIKPVLGEYRMIDRTPFYKAMWREAKECIYIEPDEDKKHKGVYWYHKM

SEQ ID NO: 81 - DNA, 1355 bp, Limnanthes alba
gcttgagactctctctctacttccccatctctatatctctctctctctctctagaagccatggcttctttcatcgcaaccacaacaccagcaatgccagctttcgcttcagttcttgatccaaaaatacccacaaaaccagaacccaaaaccgaaacccccaaaccaaaagacgatctcgaacgcttccggacatcagaagtcgtgttggagaggaaatccaaaggattctggcgccggaaatggaaccctcgtgatattcaaaacgccgtcactttactggtcctgcatgctcttgcagcgatggcgcccttttatttcagctgggatgcgttttggatctcttttatcttgcttggtttcgcaagcggtgttcttggtatcactttgtgcttccataggtgtcttactcatggcggtttcaagcttcctaagttggttgagtacttctttgcctactgtggctctctcgctcttcagggagatcccatggaatgggtgagcaaccataggtaccatcaccagttcgtcgatacagaaagagatgttcatagtccaactcaaggattttggttctgtcacattggttgggttcttgacaaagatttattcgtcgaaaaacgtggtggccgaagaaacaatgtgaatgatttgaagaaacaagccttctacagattcctccagaaaacttatatgtaccatcaattggctctaatagctctactttactacgtcggagggtttccatacattgtctggggaatgggttttagattggtgtttatgttccattccactttcgctatcaactcagtttgtcataaatggggcggaaggccatggaatactggagatttatcgaccaacaatatgtttgttgcattgtgtgcgtttggagagggctggcataacaaccaccacgcattcgaacaatcagctcgacacgggctagaatggtggcagatcgatgttacttggtacgttatcaggactctacaagctattggattggctaccaatgtgaagctaccaactgaagctcagaagcaaaagctcaaagcaaagagtgcctaaggagtttgaagcatgtaataagtgtttgtattcgatacctacttatatatgtttctagagtcgtacgtgtaatgaataaagttcgaggcagctatatagactgtgttcggatatgaaaatcgttgtattcttgtatctgatcgaaaatagctgccttgataggtgttcgataaaacattgttatgttgcttggtgtagttgtgtgggtcttgctttgtactgtattgtgttgtgtcacgttttgagattatatatagttttcttgtgttcaaaaaaaaaaaa

SEQ ID NO: 82 - protein, 356 aa, Limnanthes alba
LRLSLYFPISISLSLSLEAMASFIATTTPAMPAFASVLDPKIPTKPEPKTETPKPKDDLERFRTSEVVLERKSKGFWRRKWNPRDIQNAVTLLVLHALAAMAPFYFSWDAFWISFILLGFASGVLGITLCFHRCLTHGGFKLPKLVEYFFAYCGSLALQGDPMEWVSNHRYHHQFVDTERDVHSPTQGFWFCHIGWVLDKDLFVEKRGGRRNNVNDLKKQAFYRFLQKTYMYHQLALIALLYYVGGFPYIVWGMGFRLVFMFHSTFAINSVCHKWGGRPWNTGDLSTNNMFVALCAFGEGWHNNHHAFEQSARHGLEWWQIDVTWYVIRTLQAIGLATNVKLPTEAQKQKLKAKSA

SEQ ID NO: 83 - DNA, 1807 bp, Limnanthes alba
  misc_feature (302)..(303): n is a, c, g, or t
  misc_feature (312)..(312): n is a, c, g, or t
  misc_feature (315)..(315): n is a, c, g, or t
  misc_feature (421)..(421): n is a, c, g, or t
  misc_feature (1727)..(1727): n is a, c, g, or t
ctcactctcacacctccttctctctctttgtcggcttctccggcgagatactcaacggattcaatcgaagggtagtacaatatgtcggagacaaaacctgagaaacctttgatcgcaaccgtgaaaaacacactacctgatttaaaactatcaataaacttaaaacacgtgaaactcggttaccattacctgatcacccatggaatgtacctgtgtctccctcctctcgcactagtcctcttcgctcaaatctcaactttgtccctcaaagatttcaacgacatctgggaacagcttcagtnnaatctcatntcngtcgttgtttcatcaacacttcttgtctccttacttatcctttacttcatgactcgtccgaggccggtttatttgatggatttcgcgtgctataaacccgacgaanctcgaaaatctactagagaacattttatgaagtgtggtgagagtttgggctcttttacggaggataatatcgattttcagaggaaattagtcgcacgatctggacttggtgatgctacgtatttacctgaagctatcggtactatcccggctcatccgtcgatgaaagctgcgagaagagaagctgagttggtgatgtttggtgcgattgatcaacttttggagaagacaaaggtgaatccgaaggatatagggatcttggttgttaattgcagcctgtttagtccgactccgtccctctcgtcgatgattgttaaccactataaactccgtgggaacattataagctacaatctaggcggaatgggttgcagtgctggtttaatttcggtcgacttagctaaaagacttctcgagacaaatccaaacacttacgctttagttatgagcactgaaaatatcacactaaactggtacatgggcaatgaccggtccaaactcgtgtccaattgtcttttccggatgggaggagctgcggtcttgttatcaaacaaaacctctgataagaaaagatcgaagtatcagttggttactaccgtccgaagccacaaaggtgctgacgataattgctacggttgcatattccaagaagaagactccaacggcaaaatcggtgtaagcctctccaaaaatctaatggcggtcgcaggggacgcgcttaagactaacatcacgacgcttggtccgttggttttaccaatgtcggaacaacttttgtttttcgccacgctggttgctcgaaaagttttcaagaagaaaattaagccctacattccggactttaaactagcttttgatcatttctgtattcatgcgggtggtcgagctgttttggacgagcttgagaagaatttgcagttgtcaagctggcatctagagccgtcgagaatgacgtttatccggtttggtaatacgtcgagtagtactttgtggtacgagctggcgtattcggaagccaaagggaggattagaaaaggagaaagagtttggcagatagggtttggttctgggtttaaatgtaatagtgctgtctggaaagccttaaagagcgttgatccaaagaaagagaacaatccatggatggatgagatccaccagtttccggttgctgttgtctaaggttgtgttttgatgtttaatgtttggtgtgttgatgcttgctaattggttagtgtaagaagtacttggttgctgctgtttcaattactaactaaagagagtgttgaataagcatagaacaaagtaantaactggaaagtgctttgttgtttgttcagtaactctattactgctgaatttctctcaagagaagaattatgtttaaaaa

SEQ ID NO: 84 - protein, 505 aa, Limnanthes alba
  MISC_FEATURE (74)..(74): Xaa can be any naturally occurring amino acid
  MISC_FEATURE (77)..(77): Xaa can be any naturally occurring amino acid
  MISC_FEATURE (114)..(114): Xaa can be any naturally occurring amino acid
MSETKPEKPLIATVKNTLPDLKLSINLKHVKLGYHYLITHGMYLCLPPLALVLFAQISTLSLKDFNDIWEQLQXNLXSVVVSSTLLVSLLILYFMTRPRPVYLMDFACYKPDEXRKSTREHFMKCGESLGSFTEDNIDFQRKLVARSGLGDATYLPEAIGTIPAHPSMKAARREAELVMFGAIDQLLEKTKVNPKDIGILVVNCSLFSPTPSLSSMIVNHYKLRGNIISYNLGGMGCSAGLISVDLAKRLLETNPNTYALVMSTENITLNWYMGNDRSKLVSNCLFRMGGAAVLLSNKTSDKKRSKYQLVTTVRSHKGADDNCYGCIFQEEDSNGKIGVSLSKNLMAVAGDALKTNITTLGPLVLPMSEQLLFFATLVARKVFKKKIKPYIPDFKLAFDHFCIHAGGRAVLDELEKNLQLSSWHLEPSRMTFIRFGNTSSSTLWYELAYSEAKGRIRKGERVWQIGFGSGFKCNSAVWKALKSVDPKKENNPWMDEIHQFPVAVV

SEQ ID NO: 85 - DNA, 1456 bp, Impatiens balsamina
catttggatagaggaatcatgggagaagtgggacccacaaaccgaaccaaaaccaagttggacaagcaacaagaatccgaaaacagggttcctcacgagccacctccattcacactaagtgaccttaagaaagccatcccaccccattgcttcgagcgctccctcgtgaaatcattctaccacgtgattcacgacattatcatcctgtcctttttctactatgtcgccgccaattacatccccatgctaccccaaaacctccgttacgttgcatggccaatttattgggccatccaaggctgtgtccaacttggtatattggtcttaggccatgaatgcggccaccacgccttcagcgactaccaatgggtagacgacatggtcgggttcgtcctccactcgtcccaattgattccctacttctcatggaaacatagccaccgtcgccaccactccaacacggcctccatcgagcgcgacgaggtctacccgcccgcgtacaaaaacgacctgccgtggttcgccaaatacctacgcaaccccgtcggtcgtttcctcatgattttcggggcgctactgttcggctggccgtcgtaccttctgttcaacgcgaacggccgtctctacgaccgcttcgcttcccactacgacccgcaatccccgatcttcaacaaccgcgagaggctgcaagtgatcgcgtccgacgtcgggctcgtcttcgcgtactttgtcctgtacaagatcgcgctggccaagggatttgtgtggttaatttgtgtgtatggcgtcccgtacgtgatcctcaacgggcttatcgtcttgatcacgttcctacagcacacgcacccgaatctgccccgttacgacctttccgagtgggactggcttaggggagccctgtcgactgtggaccgcgattacgggatgttgaataaggtgttccataacgtgacggacacgcacttggtgcatcatttgttcacgaccatgccacattatcgcgccaaggaggcgaccgaggtgattaaaccgatattgggagactactataagtttgacgacactccgtttctcaaagcgttgtggaaggacatgggaaagtgtatttatgtggagtcggacgtgcctggcaagaacaagggagtttattggtacaataacgacatttgaagaggaaatggttgccggtgtctttaatgttttgtttagtttgtgttgtttcgttcaatgttatattgtgtcatgttcaaataaaataaaacggtccatgtattttgtggttgtattgtctattgtaattttacaattattctaagaaatatgtctaaaagaatttgggtcggcccaatactagtcgggtcaatccaaccccatgtcatccaacccgaatctgtgttgtaatttggccagggtggatcctctgtcccgaatcctcctgtgtcctctgtccgctatc

SEQ ID NO: 86 - protein, 383 aa, Impatiens balsamina
MGEVGPTNRTKTKLDKQQESENRVPHEPPPFTLSDLKKAIPPHCFERSLVKSFYHVIHDIIILSFFYYVAANYIPMLPQNLRYVAWPIYWAIQGCVQLGILVLGHECGHHAFSDYQWVDDMVGFVLHSSQLIPYFSWKHSHRRHHSNTASIERDEVYPPAYKNDLPWFAKYLRNPVGRFLMIFGALLFGWPSYLLFNANGRLYDRFASHYDPQSPIFNNRERLQVIASDVGLVFAYFVLYKIALAKGFVWLICVYGVPYVILNGLIVLITFLQHTHPNLPRYDLSEWDWLRGALSTVDRDYGMLNKVFHNVTDTHLVHHLFTTMPHYRAKEATEVIKPILGDYYKFDDTPFLKALWKDMGKCIYVESDVPGKNKGVYWYNNDI

SEQ ID NO: 87 - DNA, 1308 bp, Momordica charantia
ccgggctgcaggaattcggcacgagaataaattagcttctttttttaagtgagtgaagggagatctggaggcaatggggggcagaggagctattggagtactgaggaacggtggcggcccaaaaaagaaaatggggccggggcaggggctggggccgggggagcgcattacacatgccaggcctcccttcagcatcagccagatcaagaaggccattcccccccactgctttcagcgatccctccgccgctctttttcctaccttctttccgacattgccctcgtctctgccttttattacgttgccgacacctacttccaccgcctgccccaccccctactccactacctggcctggcccgtttactggttctgtcagggcgccgtactcaccggcatgtggggcatcgctcacgactgcggccaccacgccttcagcgactaccaattggtagacgacgtggttgggttcctcatccactctttggtttttgtcccttacttctccttcaagatcagccaccgccgccaccactccaacacctcatccgtggaccgggacgaggtgttcgtccccaagccgaaggccaaaatgccctggtacttcaagtacttgacaaacccgcccgccagggtcttcattatttttatcacgctcactctcgggtggccaatgtacctgaccttcaacatctccggccggtactacggccggttcaccagccacttcgacccgaacagccccatattcagcccaaaggagcgcgttctcgttcatatctccaacgctgggcttgtggcgaccgggtatttgctgtacaggatcgcaatggcgaagggggtggggtggttgatccgcttgtacggagtgccgctgatcgttttaaacgcgtgcgtagttctgatcacagcgctgcagcacacccacccttcgttcccgtattacgactcgacggaatgggattggctgagagggaatctggtgacggtggacagagattacgggcctataatgaatagagtgtttcatcacataacggacacgcacgtggttcaccatttgtttccttcgatgccgcactacaacgggaaagaggcgacggttgcagcaaagcgaatactgggagagtactaccagtttgatgggaccccaatttggaaggcggcctggagggaattcagagagtgcgtttatgtagagccagacgaagacgatggggccacttccggctccagtagtaagggtgttttctggtaccacaacaagctctgaattcaataatatcctctttcacctctctttttcat

SEQ ID NO: 88 - protein, 399 aa, Momordica charantia
MGGRGAIGVLRNGGGPKKKMGPGQGLGPGERITHARPPFSISQIKKAIPPHCFQRSLRRSFSYLLSDIALVSAFYYVADTYFHRLPHPLLHYLAWPVYWFCQGAVLTGMWGIAHDCGHHAFSDYQLVDDVVGFLIHSLVFVPYFSFKISHRRHHSNTSSVDRDEVFVPKPKAKMPWYFKYLTNPPARVFIIFITLTLGWPMYLTFNISGRYYGRFTSHFDPNSPIFSPKERVLVHISNAGLVATGYLLYRIAMAKGVGWLIRLYGVPLIVLNACVVLITALQHTHPSFPYYDSTEWDWLRGNLVTVDRDYGPIMNRVFHHITDTHVVHHLFPSMPHYNGKEATVAAKRILGEYYQFDGTPIWKAAWREFRECVYVEPDEDDGATSGSSSKGVFWYHNKL

SEQ ID NO: 89 - DNA, 1171 bp, Chrysobalanus icaco
gaaatgggagcaggtggccaaaagacattcccccgcttggaagaagaagagaagcagcagcaggcggcagctgctggcttcaagagaatcccgaccaccaagcctccattcacactcagtgacctcaagaaagcaatcccaccccattgcttccagcgctccctcctccgttctttctcctatgtcttcattgacctcaccatcatctctatcttgggctacattggcgccacctatatctgcctccttcctcctccgtccaagtaccttgcttggcttctctactgggctgttcagggctgctttttcaccggtgcttgggctcttgctcatgactgcggccaccacgcctttagtgactaccagtggatcgatgacgccgttggaatggtcctccactccacgcttatggtcccttacttctctttcaaatacagccaccgccgccatcactccaacatcaactccctcgagcgtgacgaagtgttcgtgccaaggcccaagtccaagatcaaatggtattgctccaagtacctaaataacccattaggtcgagtcctaacccttgctgtcaccctcatccttggatggcccatgtacttagccttgaatgcttccggccgagactatgaccgctttgtgtcccacttctacccctatggccccatatacaatgaccgggaaaggctacagatttacatctctgatgccggaatatttatcgttagttatgtgctctatcaggttgctctggctaaagggttgccctggctgatatgcatctacggtgtgcccttgtttgttaacaatgcgttggtggtgaccatcacgtacctgcagcacactcaccccgaactgccgcgctatggcaactccgaatgggactggttcaaggggacattggcaaccgtggatagagacatggggcctctgctcaactgggcgacacatcacgtttctgatacgcattacgtccaccatctcttctcgaccatgccgcattatcatggagtggaagctaccaaagcagtgaagcctatgcttggtgagtactataggtttgatcctactccactatacaaggcgctatggagggaggctaaggagtgcttgtttgtggagcctgactctaagagcccaggtgttttctggttcgacaagttttgagtgc

SEQ ID NO: 90 - protein, 387 aa, Chrysobalanus icaco
MGAGGQKTFPRLEEEEKQQQAAAAGFKRIPTTKPPFTLSDLKKAIPPHCFQRSLLRSFSYVFIDLTIISILGYIGATYICLLPPPSKYLAWLLYWAVQGCFFTGAWALAHDCGHHAFSDYQWIDDAVGMVLHSTLMVPYFSFKYSHRRHHSNINSLERDEVFVPRPKSKIKWYCSKYLNNPLGRVLTLAVTLILGWPMYLALNASGRDYDRFVSHFYPYGPIYNDRERLQIYISDAGIFIVSYVLYQVALAKGLPWLICIYGVPLFVNNALVVTITYLQHTHPELPRYGNSEWDWFKGTLATVDRDMGPLLNWATHHVSDTHYVHHLFSTMPHYHGVEATKAVKPMLGEYYRFDPTPLYKALWREAKECLFVEPDSKSPGVFWFDKF

SEQ ID NO: 91 - DNA, 1164 bp, Licania michauxii
atgggagcaggtggccaaaagacatgcccccgcttggtggaagaagagaagcagcagcaggcggcagctgctggcttcaagagaatcccgaccaccaaacctccattcacactcagcgacctcaagaaagcaatcccaccccattgcttccagcgctccctcctccgttctttctcctatgtcttcattgacctcaccatcatctctatcttgggctacattgccgccacctatatctacctccttcctcctccgtccaagtaccttgcttggcttctgtactgggctgttcagggctgctttttcaccggtgcttgggctcttgcccatgactgcggccaccacgcctttagtgactaccagtgggtcgatgacgccgttggaatggtcctccactccgcgctcatggtcccttacttctctttcaaatacagccaccgccgccatcactccaacatcaactctctcgagcgtgacgaagtgttcgtgccaaggcccaagttcaagatcaaatggtattgctccaagtacctaaataacccattaggtcgagtcctaacccttgcggtcaccctcatccttggatggcccatgtacttagccttcaatgcttctggccgagactatgaccgctttgtgtcccacttctacccctatggccccatttacaatgaccgggaaagactccagatttacatctctgatgccggaatatttatagttagttatgtgctctatcaggttgctctggctaaagggttgccctggctgatatgcatctacggtgtgcccttgtttgttaacaatgcgttggtcgtgaccatcacgtacctgcagcacactcaccctgaactgccgcgctatggcaactccgaatgggactggttcaaggggacattggcaaccgtggatagagacatggggcctctgctcaactgggtgacacatcacgtttctgatacgcattacgtccaccatctcttctcgaccatgccgcattatcatggagtggaagctaccaaagctgtgaagccgatgcttggtgagtactacaggtttgatcctactccagtgtacaaggcactatggagggaggctaaggagtgcttgtttgtggagcctgactctaagagcccaggtgtcttctggttcgacaagttttga

SEQ ID NO: 92 - protein, 387 aa, Licania michauxii
MGAGGQKTCPRLVEEEKQQQAAAAGFKRIPTTKPPFTLSDLKKAIPPHCFQRSLLRSFSYVFIDLTIISILGYIAATYIYLLPPPSKYLAWLLYWAVQGCFFTGAWALAHDCGHHAFSDYQWVDDAVGMVLHSALMVPYFSFKYSHRRHHSNINSLERDEVFVPRPKFKIKWYCSKYLNNPLGRVLTLAVTLILGWPMYLAFNASGRDYDRFVSHFYPYGPIYNDRERLQIYISDAGIFIVSYVLYQVALAKGLPWLICIYGVPLFVNNALVVTITYLQHTHPELPRYGNSEWDWFKGTLATVDRDMGPLLNWVTHHVSDTHYVHHLFSTMPHYHGVEATKAVKPMLGEYYRFDPTPVYKALWREAKECLFVEPDSKSPGVFWFDKF

SEQ ID NO: 93 - DNA, 765 bp, Aleurites fordii
aaggcgataccaccgcattgcttccagcgttctgtcctccgttcattctcatatgttgtttatgacctgaccgtggcctttatcttctattatattgccaccaattacttccacctccttcctcaacctctctcttatgtggcctggccaatttactgggcccttcagggctgtgtcctcactggcgtttgggttatagcacatgagtgtggacatcatgccttcagtgactatcaattgcttgatgacattgttggccttgtcctccattcctgtcttcttgtcccttacttttcatggaaacatagccaccgccgtcaccactctaacacagcttcccttgagcgagatgaagtgtttgtccccaagaagaaatctagcatccgctggttctctaaataccttaacaacccaccaggccgtctatttacacttaccatcacacttacccttggctggcctctatacctagctttcaatgtttcaggcaggccttatgatcggttcgcctgtcactatgacccatatgggcctatctatactgatcgtgagcgaactgaaatatacatctctgatgctggtgttcttgctgtcacttttggtctctaccgtcttgctgcagcaaaggggcttgcttgggttatttgtgtttatggagtaccattgttaattgtgaatgcatttctagttatgataacatatttgcagcatactcatccttcaataccacattatgattcttccgagtgggactggctccgtgga

SEQ ID NO: 94 - protein, 255 aa, Aleurites fordii
KAIPPHCFQRSVLRSFSYVVYDLTVAFIFYYIATNYFHLLPQPLSYVAWPIYWALQGCVLTGVWVIAHECGHHAFSDYQLLDDIVGLVLHSCLLVPYFSWKHSHRRHHSNTASLERDEVFVPKKKSSIRWFSKYLNNPPGRLFTLTITLTLGWPLYLAFNVSGRPYDRFACHYDPYGPIYTDRERTEIYISDAGVLAVTFGLYRLAAAKGLAWVICVYGVPLLIVNAFLVMITYLQHTHPSIPHYDSSEWDWLRG

SEQ ID NO: 95 - DNA, 765 bp, Aleurites fordii
aaggcgataccacctcattgttttaaacgctcccttcttcgctccttctcttatgttgtttatgacctttctttaagttttattttctactccattgccaccacctacttccatctcctcccttctccgataacctacatcgcttggcctgtctactgggctttccaaggctgcattctcactagtgtttgggtgctcggccatgaatgtggtcaccatgcttttagcgaatataattggcttgatgacactattggcctaattctccactcttcacttctagttccatacttttcatttaaaattagccatcgtcgccatcactctaacattgcatcacttgaacgcgacgaggtgtttgtccctaggctcaagtctgcaattccatggtattccaagtacctcaacaacccaccaggccgagctttaacccttgtagctacactcttcattggctggcctttatatttagccttcaatgtttcgggccgatactatgatcgctttgcctgccattatgatccttatagtcctatatattctgatagagaaaggcttcagatttacatttctgatgctatgattttcgttgcagcttatgtgttgtataagattgccatggcaaaagggctagcatggctggtatgtatctatggggtaccattgcttattgttaatgctcttgttgtgactatcacatccttgcagcacacccacgttgcattgccacattatgactcctcagagtgggactggctccgcgga

SEQ ID NO: 96 - protein, 255 aa, Aleurites fordii
KAIPPHCFKRSLLRSFSYVVYDLSLSFIFYSIATTYFHLLPSPITYIAWPVYWAFQGCILTSVWVLGHECGHHAFSEYNWLDDTIGLILHSSLLVPYFSFKISHRRHHSNIASLERDEVFVPRLKSAIPWYSKYLNNPPGRALTLVATLFIGWPLYLAFNVSGRYYDRFACHYDPYSPIYSDRERLQIYISDAMIFVAAYVLYKIAMAKGLAWLVCIYGVPLLIVNALVVTITSLQHTHVALPHYDSSEWDWLRG

SEQ ID NO: 97 - protein, 387 aa, Ricinus communis
MGGGGRMSTVITSNNSEKKGGSSHLKRAPHTKPPFTLGDLKRAIPPHCFERSFVRSFSYVAYDVCLSFLFYSIATNFFPYISSPLSYVAWLVYWLFQGCILTGLWVIGHECGHHAFSEYQLADDIVGLIVHSALLVPYFSWKYSHRRHHSNIGSLERDEVFVPKSKSKISWYSKYSNNPPGRVLTLAATLLLGWPLYLAFNVSGRPYDRFACHYDPYGPIFSERERLQIYIADLGIFATTFVLYQATMAKGLAWVMRIYGVPLLIVNCFLVMITYLQHTHPAIPRYGSSEWDWLRGAMVTVDRDYGVLNKVFHNIADTHVAHHLFATVPHYHAMEATKAIKPIMGEYYRYDGTPFYKALWREAKECLFVEPDEGAPTQGVFWYRNKY

SEQ ID NO: 98 - DNA, 1457 bp, Calendula officinalis
aaaccactatactacacctagctacgtaccatgggcaaaggagcatcaaacaagaaggttttggaacgagttccaatcacaaaaccgccattcgaatacaatgatctgaagaaagcagtaccaccacattgtttttcacgaccacttttccgttcgttttatttcctacttcacgacattattgtaacatgtatccttttctacgtagcatcaaactacattcctatgctccctggtttcctttcctacattgtatggcctgtttactggatctcccaaggagtttttcttggcagattgtggatgattggccatgaatgcggccatcatagttttagtaattaccgttgggtcgacgatagtgttggttttttaatccatacggccaccctcactccctatttttccttcaaatatagtcaccgtaatcaccatgcacacaccaattccatggaatatgacgaagttcatatcccgaaacgcaaatccgaagctctagatctctactttgaatttctcggcaacaacccgatggggttaatgatcaccatgttatgtaaactcacttttggatatgcagcttacattatgttcaattatacaggcaagaagcacaaatctgggggtttagcaagtcacttctacccacaaagccctctctttaacgacagcgaacgtaatcatgttttgttctctgatgtcgggatttgcatcgtcttgtacgcatgttaccgtattgtgatggtcacaggggcaatgtcggcattttatgtgtacggcattccttgggttataatgagtgctattctctttgcagcaacttatttacaacacactcatccttcgatccctcattatgatacaactgagtggaactggcttagaggggcattatcgacaattgatagagatttagggttcttcaacatgaacaaaacacattatcatgttatccaccatttatttcctgtcattccggaataccatgcacaagaggcaactgaggccatcaagcccatcttaggtcaatattacaagtatgatggtactccgtttttaaaggcgttgtggagagaaatgaaggactgtatttatgtagaatccgatcaaggtcagaagaaacaaggtatttactggttcaagaataagatttgaagtttcaaataatctggactacgtttaattttgtgccatcatcagtaccgtgaattagttttgttgtggagagaaatgaaggactgtatttatgtagaatccgatcaaggtcagaagaaacaaggtatttactggttcaagaataagatttgaagtttcaaataatctggactacgtttaattttgtgccatcatcagtaccgtgaattagttttgttgtgtttttaattttaatttcgtgtgatggtgtaatgtaatataattcagtataataaaggcgttatcctttcatgggtttaaaa

SEQ ID NO: 99 - protein, 374 aa, Calendula officinalis
MGKGASNKKVLERVPITKPPFEYNDLKKAVPPHCFSRPLFRSFYFLLHDIIVTCILFYVASNYIPMLPGFLSYIVWPVYWISQGVFLGRLWMIGHECGHHSFSNYRWVDDSVGFLIHTATLTPYFSFKYSHRNHHAHTNSMEYDEVHIPKRKSEALDLYFEFLGNNPMGLMITMLCKLTFGYAAYIMFNYTGKKHKSGGLASHFYPQSPLFNDSERNHVLFSDVGICIVLYACYRIVMVTGAMSAFYVYGIPWVIMSAILFAATYLQHTHPSIPHYDTTEWNWLRGALSTIDRDLGFFNMNKTHYHVIHHLFPVIPEYHAQEATEAIKPILGQYYKYDGTPFLKALWREMKDCIYVESDQGQKKQGIYWFKNKI

SEQ ID NO: 100 - DNA, 1311 bp, Calendula officinalis
aggaattcggcaccagccaaaaccaaagccactataccatgggcaaggcagcatcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacaaggtatttattggtttaaaaataagacttgaagtttaacataatctggactacgtttaattttgtgccatcagtacgtacggtgttagttttgttgtgttttcatttttcgtattttgtgtgatggtgtaatgtaatataattcagtataataaaggagttatcctttgatgggtttaaaaaaaa

SEQ ID NO: 101 - protein, 372 aa, Calendula officinalis
MGKAASAKKVLERVPISKPPFEYNDLKKAVPPHCFSRPLSRSLYFLFHDIIVTCILFYVASNYIHMLPRFLSCIVWPVYWISQGVFLGRLWMIGHECGHHSFSNYRWVDDTVGFLIHTATLTPYFSFKYSHRNHHAHTNSMEYDEVHIPKRKSEALYFEFLGNNPIGLMITMLCKLTFGYAAYIMFNYTGKKHKSGGLASHFYPQSPLFNDSERNHVLFSDIGICIVLYACYRIVTVTGAMPAFYVYGIPWVIMSAILFAATYLQHTHPSIPHYDTTEWNWLRGALSTIDRDLGFFNMNKTHYHVIHHLFPVIPEYHAQEATEAIKPILGQYYKYDGTPFLKALWREMKECIYVESDEGQKKQGIYWFKNKT

SEQ ID NO: 102 - DNA, 1361 bp, Dimorphotheca sinuata
ggcacgagctacaagaaaccttcaacaacaaaatgggagcaggaggttgcatctctgtctccgaaaccaaacccaaccaaaaaaacagtctcgaacgagccccttacgacaaaccgcctttcaccatcagcgacctcaaaaaagccatccctccccacttatttaaacgttccttaatccgttcattatcttacgtcgcctctgacctcaccgtagccttcctcctctaccacgccaccacctacttccaccacctcccgcaaccgttcaccgccctcgcatggctagcttattgggtagcccaagggtgtgtgctcaccggagtttgggtcataggccatgaatgtggtcaccatggacttagcgaatatcgaggggttgacgacacggttggctacatactccactcgtctttactcgtcccgtatttctcgtggaaatatagtcaccgtcgccaccactccaacaccggatcactcgaccgcgatgaagtattcgtcccaaaaccaagatcaaaaatatcatggtattcaaagtactttaacaacccggtcggacgaatcggggttctattcatcacgctcactctcggctggccgttatacttaactttcaatgtttccggaagaccctacgaccgtttcgcgtgccactattctcctaacagcccgatatacaacaaccgtgaacgcttccaaatttatctttccgatatcgggatcgtcatcacgtcattagtccttttacgtgctgcgatggtgaaagggttggtttggttaatttgcgtctacggggtcccgttaatgataacgaacgggtttcttgtattggttacgtatcttcaacatactcacccttcattgcctcattacgataactcggaatgggagtggttaaagggagcattagtgactgtggaccgtgattttggtgtgttaaacacggtgtttcatcacgctacggatggacacattgtgcatcatttgttcccaacaataccacattataacgcgatggaagcaactaaagcggtgaagcctttgatgggggagtattatcagtatgacgcaactccgttttatgtagcgatgtggagagaggcgaaggagtgtttgtttgtcgatcgggatgagggggagaaaggaggtgtgttttggtacaagaataaaatgtaatgtgtgtatgtgtgagtttttagtttaggtagtttatgagtatggctggtgtttttagtaatgttgcgtgtgtgtgtgtgttcgaaccttgtgtatgyggttgtgtyatgtgtatgataaatgtaatgtacctcattaaaaggacttatgttatctaaaataagaatgtktcttgttggttatcgg

SEQ ID NO: 103 - protein, 380 aa, Dimorphotheca sinuata
MGAGGCISVSETKPNQKNSLERAPYDKPPFTISDLKKAIPPHLFKRSLIRSLSYVASDLTVAFLLYHATTYFHHLPQPFTALAWLAYWVAQGCVLTGVWVIGHECGHHGLSEYRGVDDTVGYILHSSLLVPYFSWKYSHRRHHSNTGSLDRDEVFVPKPRSKISWYSKYFNNPVGRIGVLFITLTLGWPLYLTFNVSGRPYDRFACHYSPNSPIYNNRERFQIYLSDIGIVITSLVLLRAAMVKGLVWLICVYGVPLMITNGFLVLVTYLQHTHPSLPHYDNSEWEWLKGALVTVDRDFGVLNTVFHHATDGHIVHHLFPTIPHYNAMEATKAVKPLMGEYYQYDATPFYVAMWREAKECLFVDRDEGEKGGVFWYKNKM

SEQ ID NO: 104 - DNA, 1337 bp, Dimorphotheca sinuata
gggggatgggagcatctgaggagatgaaggtcttggaacgagttccagtctcaaaacctccattcgagtacaatgatctgaagaaagcagtaccaccacattgttttacacgatcactttcactctcgttttattacctgttttatgacctaataaaagtatgtatccttttctacgtagcctcaaaatacattcctatgcttccttatagcctttcctgcattgtatggcctctttactggttcttccaaggagcttttctaggcagattgtggatgattggccatgaatgcgggcatcatagctttagtaattatcgttggttagacgataccgttgggttcttggtccacactgccaccctcactccatatttttctttcaaatacagtcaccgtaatcaccatgcacacaccaattccttggagtatgacgaggttcatgtccctaagattaggaaatttaaatccgaacatctctactctgaatttctcaccaacaacccatttggcttagtggtcaacatggtatttgaactcacttttggatacccatcttacttaatattcaattattcaggtagaaagcttactcaagctggttttgcaagtcacttgtacccacaaagcccaatcttcaacgatagtgaacgtaatcatgtgtttttctctgatgttggtatttgcattgtgttatacgcattataccgcatagcgatagccaaaggcgcaatgctagtgttgtatgtgtatggtcttccttgggttgtaatgagtgctttcatcttttcccttacttatttacaacacactcatccttccatccctcactatgattcaactgagtggaattggctcagaggtgctttatcctcaatcgacagagaattagcaggggccttcaacatcaaaaaaacacattatcatgttgtgcaccatttgtttccctttattccagaataccatgcacacgacgccaccgaggcccttaagcccatcttaggcccatattacaagtatgatggcactccgttttataaggcgttgtggagagaaatgaaggactgtctttatgttgaatctgatgatggccccaacaaaactggtgtttactggttcaaaactaagacttgattaatcagctggcgtgtcaccagcccgcccgggttcgggttagggttagggttaatttcattgcagtaattttctttttcatttctttttatttttcttttatattgttctcagtacctgtatgtttgggttattgtgtaatgtataataattcagtttaataaaaccctttatattttgatattaaaaaaaaaaaaaaaaaaa

SEQ ID NO: 105 - protein, 375 aa, Dimorphotheca sinuata
MGASEEMKVLERVPVSKPPFEYNDLKKAVPPHCFTRSLSLSFYYLFYDLIKVCILFYVASKYIPMLPYSLSCIVWPLYWFFQGAFLGRLWMIGHECGHHSFSNYRWLDDTVGFLVHTATLTPYFSFKYSHRNHHAHTNSLEYDEVHVPKIRKFKSEHLYSEFLTNNPFGLVVNMVFELTFGYPSYLIFNYSGRKLTQAGFASHLYPQSPIFNDSERNHVFFSDVGICIVLYALYRIAIAKGAMLVLYVYGLPWVVMSAFIFSLTYLQHTHPSIPHYDSTEWNWLRGALSSIDRELAGAFNIKKTHYHVVHHLFPFIPEYHAHDATEALKPILGPYYKYDGTPFYKALWREMKDCLYVESDDGPNKTGVYWFKTKT

SEQ ID NO: 106 - DNA, 8149 bp, Artificial Sequence
  vector
ggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatggagtcgattgcgccattcctcccatcaaagatgccgcaagatctgtttatggaccttgccaccgctatcggtgtccgggccgcgccctatgtcgatcctctcgaggccgcgctggtggcccaggccgagaagtacatccccacgattgtccatcacacgcgtgggttcctggtcgcggtggagtcgcctttggcccgtgagctgccgttgatgaacccgttccacgtgctgttgatcgtgctcgcttatttggtcacggtctttgtgggcatgcagatcatgaagaactttgagcggttcgaggtcaagacgttttcgctcctgcacaacttttgtctggtctcgatcagcgcctacatgtgcggtgggatcctgtacgaggcttatcaggccaactatggactgtttgagaacgctgctgatcataccttcaagggtcttcctatggccaagatgatctggctcttctacttctccaagatcatggagtttgtcgacaccatgatcatggtcctcaagaagaacaaccgccagatctccttcttgcacgtttaccaccacagctccatcttcaccatctggtggttggtcacctttgttgcacccaacggtgaagcctacttctctgctgcgttgaactcgttcatccatgtgatcatgtacggctactacttcttgtcggccttgggcttcaagcaggtgtcgttcatcaagttctacatcacgcgctcgcagatgacacagttctgcatgatgtcggtccagtcttcctgggacatgtacgccatgaaggtccttggccgccccggataccccttcttcatcacggctctgctttggttctacatgtggaccatgctcggtctcttctacaacttttacagaaagaacgccaagttggccaagcaggccaaggccgacgctgccaaggagaaggcaaggaagttgcagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcttactgcgccttacccatcttggaggtagccttggagacctcgttcagacggctaaagacctctgcagttccctcgatcataccggtggtgtggtatcggacattgtactttttgcacagggtctcgacagcaggctggatctttgaaaagttgtggcgaggcatcgaagggaacaagtggtgctcgatctgatagttcaatccacccgtgaaccagttggcaaatagacccgggtggacatcacgacccgtgatgatctgcttcgtgaagaaatccatatcgaccgcctcctccttcgagatcacaggcataccgttgtggttgagcgagaacacgatcgccaacaagtttccgcacaccgcctgcgacaccaaaaagtacaccagcatgttgacgggatccttgatgaacaggaacatggtggcgaggtaccaggtccagtgcatcgcaagcgacagctgctcgaccaacgagatgggcacacgcgcgcccgagggcttgtgggcctgaccgttaggcagcacaaagagaatggactggaggcaccaggagagacgggcaaacgagagaatggggaagtaaaaccaggtctggttcaggaccatgaaacgcgaccacatgcgggtcagctcctcatctgggacatccgagaacatctccaacgcatgctcactccaggtcaacagagggtgggtgtcaatgtcgggatcctcgccgtggacgttgggggcggcgtggtgagtgttgtgcttgtccttccaccacgaggacgagaagccctggcagacacctcccaagaaggcgccgaaaagatcaccccagaaacggtcctggaagacctggtgatgcaaaaagtcgtgagccaaccatccgcactgctgccagaacagacccaaaagcgcagccgagagcacgttggcgagggtcgaggtctggccccacttggccacaatgaccgtcgacaaaccccagatgcagaggttgaacgagaccttgaaggcgtagtatgccttggaagaatcgtagtaaccaagagactggaacaaggtacgcagcttgcggacctcggccgcaaagtcatcattcttgatatcgcggtcgctctcgtcaatatcaccaacgtaaaagttggcaagagtctcccaagcagcctcggggtgaaaagtgtcaaagacgtcagtgccgtccttgccaacgtgcgtgagaatcacacttccaccgggatgatcagggacgaactcgcggacatcgtacaccttgttgtcgatgatcatcaagaagggtgcctcggcatccttcttgccctcattcagagcctcggcattcaaaacctcggcccgagtaaacgtcctcacactgggagcagcagccatggtttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgca

SEQ ID NO: 107 - DNA, 8641 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 108 - DNA, 40 bp, Artificial Sequence
  primer
agcggccgcaccatgggaggtggtggtcgcatgtctactg

SEQ ID NO: 109 - DNA, 37 bp, Artificial Sequence
  primer
tgcggccgcttaatacttgttccggtaccagaaaacg

SEQ ID NO: 110 - DNA, 4697 bp, Artificial Sequence
  vector
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagcggccgca

SEQ ID NO: 111 - DNA, 8260 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagc

SEQ ID NO: 112 - DNA, 8260 bp, Artificial Sequence; identical to SEQ ID NO: 111
  vector

SEQ ID NO: 113 - DNA, 10763 bp, Artificial Sequence
  vector
ggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcagcccgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcacatcacacgtaactccatatcaggatatcctgctcgtgctttatgcgtatcaaataactctttaagtgctttcacaaactcatcatgtacttcattaacctcttccatagtgggagtagaactcttcttcacttgtattggcttaccgaccaccacaagaacaggtcgtcgaaacggtataggagaccaaaatttacccccgaaaaatataggcgtgaacttgacagctcgggtcagtttcagataaagttccccctttggcctccaatactggtaagcagctgactgcccaaaggcgaaaacagggaccaagggagaaccagtctccattgcgagacgtatgaacccttttcttgcttttaaaaaggcaacctctgaattaggctccatgtaaaagacctcacgtactccacctgggacaactacgcaactataaccgttttttaaaagagacttgaagttttcccttgttgccggtgacactcccatccatgtccatatatgcctcatgaacggcgttaagaacacagcggtacttgcaaggatcttgactttgcctgtaggcaaaaaaccggtgaaatgtgatattgccccagctccaaatggacaaaccgaatggggttcgtatccaaaaacgtaagtctgatcaggattgaatgctttaatatcttcaacatatacagaagcagggaaatgaccacccccatgcttatatatgtacctggctaaagctaagccccatttactgtcctcattaatggggatgaacatcaagaccacaaatattcccactaccaggaggtatttgtgaaaggggagcaataagaaggtggtgacattaataattccgataaaatgaacagcaccgagccacactaaaagtgcaacatatgtatgaattggtgaaatgattttacttgtgaacaacgccggtgttggtggttctgctgctgctggtggtggtggcaggattaatccatttgtctcctccgtcttcgacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgca

SEQ ID NO: 114 - DNA, 14674 bp, Artificial Sequence
  vector
  misc_feature (13499)..(13499): n is a, c, g, or t
gtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcacatcacacgtaactccatatcaggatatcctgctcgtgctttatgcgtatcaaataactctttaagtgctttcacaaactcatcatgtacttcattaacctcttccatagtgggagtagaactcttcttcacttgtattggcttaccgaccaccacaagaacaggtcgtcgaaacggtataggagaccaaaatttacccccgaaaaatataggcgtgaacttgacagctcgggtcagtttcagataaagttccccctttggcctccaatactggtaagcagctgactgcccaaaggcgaaaacagggaccaagggagaaccagtctccattgcgagacgtatgaacccttttcttgcttttaaaaaggcaacctctgaattaggctccatgtaaaagacctcacgtactccacctgggacaactacgcaactataaccgttttttaaaagagacttgaagttttcccttgttgccggtgacactcccatccatgtccatatatgcctcatgaacggcgttaagaacacagcggtacttgcaaggatcttgactttgcctgtaggcaaaaaaccggtgaaatgtgatattgccccagctccaaatggacaaaccgaatggggttcgtatccaaaaacgtaagtctgatcaggattgaatgctttaatatcttcaacatatacagaagcagggaaatgaccacccccatgcttatatatgtacctggctaaagctaagccccatttactgtcctcattaatggggatgaacatcaagaccacaaatattcccactaccaggaggtatttgtgaaaggggagcaataagaaggtggtgacattaataattccgataaaatgaacagcaccgagccacactaaaagtgcaacatatgtatgaattggtgaaatgattttacttgtgaacaacgccggtgttggtggttctgctgctgctggtggtggtggcaggattaatccatttgtctcctccgtcttcgacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcattgatcttttcgtgctttagatctaacaggctttgttttgattacattaccaagaaggattaaaaccacaggaataatagttccaatgtagtatacactcccgtatgcagtcactgtttcgtgtaggcttaataccatgaaaccaacacatgagtagttgagaacgagaagtgtataagcgaagtttacaagcataaaaatcttcttaagcaaccccaaatttgggggaacagattgctgccatctgtaaatggctcttgaaccagcaatcatcaaagctgattgaacaaaaaatatgatgtaccctggatataatccatgccatacagcactaacagtctgtgttgcaagcaattggaagaaaccagcctttttcccctttttaacaagtctgtcataaacatagtgacgaagccatgtgctgacttgaatattccatacaagtggtatctccactgcactcctagcaaactcaacacccaaaacatcaacatttttagcccggtcccaccgggccttgggtggagaagaatcggcccacccactaaagcccaaaccagaaataacaatagaagcttctgaaatggaccatatgaaataatatttccaacgggccgtaaagcccgccatgtattggtaactcaatcgtttccagaatccccattctttatatatcgggtcagtgaattttgataacgggtaatgaggtaccaaatataagtacaaacccatacagacaccagcttgaacaagagctttgacggttggcccgaaaggtgatggtgaacccttttccgactttatccagatccctttgccttctgtccaatctaagtaatccttaatttcataaactgggcctgcaaaatgacttccacaacaaagacaaaatcccacatactcgattaaagaaggcagcttaagtaactgatttttcttctgggattcgcgaagatcttcatcttttagtaatccatcattgtaattaatcgcgcacgaaataacttttaatgttattaccataagagctccagtagcatcaatacctccttccttccatgcatccccactcatgtagtatacatggcatccaatgaggtatcccatagctaacacgaatgtaattaagccgcatcgtttccgatagaccaccattgacacgtaactgaccaacataggcacgagaaagtgtagatttgaagagaaaccaaaggataagtaagagagtacaacgccggtagaggcggcgtacaagtgttttccggtggggccgccggggatgaggcgatggaaaaagccggcaggaatagtggcgacgaagcatagaaggaatcggagtaccggcaccgatactccgatagccgtcgccgttgattccatatccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 115 - DNA, 7093 bp, Artificial Sequence
  vector
  misc_feature (4083)..(4083): n is a, c, g, or t
ccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgccaattcatgacggtgggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgaaagcttacgcgtcgacccgggtatccgtatgatgtgcctgactacgcatgatatcgcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccccgggtaccgagct

SEQ ID NO: 116 - DNA, 6903 bp, Artificial Sequence
  vector
  misc_feature (4582)..(4582): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccccgggtaccgagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtgagc

SEQ ID NO: 117 - DNA, 12229 bp, Artificial Sequence
  vector
  misc_feature (11054)..(11054): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 118 - DNA, 10767 bp, Artificial Sequence
  vector
ggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggtctcaatagattaagaagttggcgtctcattgattgaccatgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcaaagaactttcagctgcagattatcatagccaagctgtgctttgtacctttcaaatatatcctggagtgcttcaacaaactgaccgtgtacatcaagaacctcatcactcgttgggtttggatttttcttcacctcaatgggtctccccaccaccacatgcatccgccgcctaaagggaaggggagatccgaaaactccccagaagacaattggagtgaacttgatcgctctagaaaattggaggaacaacttcccaccaggcttccaccaatgatagacgctcgactgaccaaagcagaaaactgggaccaggggtgtgcccatctccatcgctaagcgaacaaatcctcgtcttgtcttgaggaagacagtctccgaattatgctccatatgaaatgtctcttgtactccaccaggcacaatgatacaactatagccagctgccaagagggagatgaaatttttctttgttgctggcgttagacccatccatgtccatatgtgcctcaaaaacggtgtataaaacacagcggaactagcaaggacttttattttttggagaggcatgaaaccagtaaggtcgctcaatgcaacaacaccaataggtaaaaccgaatgtggctcataaccaagaacataagcacgattgggatcaaaggcatgtatatcttggacatgtagagtaataggaaaataggcggtagcgcttttacatatatacctggccaataagcgaccgtatttggctttgtcgttgacaggaattagcactaatatgaaaagtaaggcgccgaccgagagggctttggggagggagaggtagaagagggagatgaggcctagagcaaaattgagatgaatggcgccgagccaaatacacaaggctgcgattacgtgcaagtgcatcatccggcatttggtgggcgacccatctcccttgaaaactgtgaccgacggcaccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgca

SEQ ID NO: 119 - DNA, 14648 bp, Artificial Sequence
  vector
  misc_feature (13473)..(13473): n is a, c, g, or t
gtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcaaagaactttcagctgcagattatcatagccaagctgtgctttgtacctttcaaatatatcctggagtgcttcaacaaactgaccgtgtacatcaagaacctcatcactcgttgggtttggatttttcttcacctcaatgggtctccccaccaccacatgcatccgccgcctaaagggaaggggagatccgaaaactccccagaagacaattggagtgaacttgatcgctctagaaaattggaggaacaacttcccaccaggcttccaccaatgatagacgctcgactgaccaaagcagaaaactgggaccaggggtgtgcccatctccatcgctaagcgaacaaatcctcgtcttgtcttgaggaagacagtctccgaattatgctccatatgaaatgtctcttgtactccaccaggcacaatgatacaactatagccagctgccaagagggagatgaaatttttctttgttgctggcgttagacccatccatgtccatatgtgcctcaaaaacggtgtataaaacacagcggaactagcaaggacttttattttttggagaggcatgaaaccagtaaggtcgctcaatgcaacaacaccaataggtaaaaccgaatgtggctcataaccaagaacataagcacgattgggatcaaaggcatgtatatcttggacatgtagagtaataggaaaataggcggtagcgcttttacatatatacctggccaataagcgaccgtatttggctttgtcgttgacaggaattagcactaatatgaaaagtaaggcgccgaccgagagggctttggggagggagaggtagaagagggagatgaggcctagagcaaaattgagatgaatggcgccgagccaaatacacaaggctgcgattacgtgcaagtgcatcatccggcatttggtgggcgacccatctcccttgaaaactgtgaccgacggcaccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactcttcttttcgagctttggatcgaaccggtcttgcgggtttaattatggagccaagtaagatcagtgtgacgggaatgacggttccgatgtagtacacgcttccatacgaggcaagcgtctcgtgcaaactcaagaccatgaaaccgacgcaggaatagttcagaaccaaaactgtgtaagcaaagttaaaaaatccgagtatgattttgaggaaagccaaggttggaggaacagctacttgccatctgtaaataactcttgaaccagcaatcatcagagcagactgaacaaagaagattatgtacccaggatacagaccatgccaaacagcactgacagtctgtgttgccagcagctgaaagaaaccaggtctcttccccttttgaaccagcctctcataaacataatgacgaagccaggtgctgacttgaatattccatttaagaggaatctcaactgcactcttcaccaactcaagacctataatatcgacgtttattgcacggtcccagctcggtttgggtggagaagactttgtccaaccactgaaacccaagccggaaataatgatggcagcctccgaaatcgaccagatgaaataatatttccagcgtgctgtaaagcctgccatatactggtacccaagacgcttccagaatggccattcaaggtagacgggatcaataaagcgggacaatggaaactgaggtaccaggtacaaatacaagcccatacaaaaggcagcttggaaaagagctcgaattgtagcgaaatatggtgatggagatgggttttgttcatcatgcttccaaatcccatttccttcagtccactcaagataatccttcatttcataaacaggaccagcaaagtggctgccacagcagaggcaataaccgatgtactcgattgatgagggcaacttaatcaatcgatttttcttttgagcctcacttaaaccttcttcttttaacaacccatcattataatttattgcacatgaaatgactttcagtgtcaataccatcaaggccccagttgcatcaatacctccttccttccaagcgtccccactcatgtaatatacatggcagccaatgagatagccgaaacccaaaaagaaggtaatgaagccgcaatggcggtggaagaggagcatggaagcgtaacccagggacatggggaccaagaaatggaggttggaagagaagccgaaggagaggtaagagagaagaacgccggagagggcggagtagaggtgcttggggaggcggccggggacgagacgccataggaaactgaccgggattgtggcgacgaagcagaggaggaagcggagaacggggacggagatgccaatggaggcggcgaggggttccatctccaggcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 120 - DNA, 3519 bp, Glycine max
atgtccatggattctatggccacttccatcggagtctcggtccccgtgctccgcttcctcctctgcttcgccgccaccgtgcccctcagcttcctctgccgcttcctcccccgcggcctccccaagcacctctactcctccgtcgtcggcgtcgccctctcctacctctccttcggcttctcctccaacctccacttcctcgtccccatgttccttggctacgcctccatgctcctctatcgtcctcgatgcggcatcctcaccttcttcctcggatttggctacctcattggctggttcgtacaatcgatctattttctcttcactattcaattctccccccctctctttgacctagccccgcgtttgcctttctctcttctgcagccacgtgtattacatgagcggtgatgcatggaaggaaggtggcatcgatgccactggtaagcgccaattaattactattattttatattttatattttattatttagattgaggaatgagggaattgactggtaaggttattttgaggtgaaagttggttggtttggtcattaattgtggtacctggttggtttgggaataggggctttaatggttttgacgctcaaggttatctcctgtgcggttaattacaacgatggtttgctgaaagaggagggtttgcgtgaggctcagaagaagtaccgtttgatcaagttgccttccttgattgagtacattggttactgcctctgctgtggaagtcactttgctggtcctgtttatgaaatgaaggattatcttgattggactgaaggaaaaggggtattgtttattgttaactgtttattatcctgattttggttgataagaattagcagaatgcactggcattgaatgctgaattctccttaaatttgaactgaaaaaattccagtagtagagcagttactcttcttatttttttttatttttaatgctgataagttatgaatgatttttctcaacttctcgtgttcgttatttcaatcttattattagtctttattattgctattatgggcagatttggggcactgaagcaaaagggccatcgccatcaccttacggggcgacccttcgggctcttctccaagctggtttttgcatggccatgtatttaaacctcgtgcctcattttcctttgtccaaatttactgatcctacctaccatgaatggtgtttctggaaaaaattaagttaccagtatatgtctggctttactgcacgctggaagtattatttcatctggtcaatttcagaagcttctattatcatctctggcctggggttcagtggctggactgattcgtccccacctaagcctcgctgggaccgggccaaaaatgttgatataattggtgttgagtttgcaaagagtgcagttactattccagctgtgtggaatattcaagtcagcacctggcttcgtcattgtgagtttcttgctaatgagattgaatgcttttattgcagggtttgattaactatctcagtaggatatagccattattcaatttaggcatagaacttagtttacggtcctggctgcatcatttataagttctggtaacaatttggccatagtattttttaggtggttacacctacacacgtatggttctttattaacatctgaatttggatgaacttttcaattagcacttatgggaggagaaaattagaaaaaggtcaaatgaattaagtttatcctataagttaatcagcttttggagaagttaaatgaaagagcttctatagaagttgaagtacataagtcgacttatggaagaagctttattgattttacatttttactttcttattttcttctcctataactataaatacttagaagtttataaaaaaaggacttagtctgaactttgtaccagggattagttgggccatgctaataatctctcttcttgagttagaacatggtttttgtttacactaaattatagcatgagcaagccatcaaccctggaccaaaaaaaaaaatagtgaagctaccaacaattgattttaaatattttttattgttcttacactgtagacttagctagatgcaaaattgaaaattgatgtagattacctatttatatgtcattcataaagcttgacaataaaatataaaattgtaattttcttgttgtttgggttttggtagatgtttacgaaaggcttattcagactgggaagaaaccaggtttctttcagctacttgccactcagaccgttagtgccgtttggcatgtgagtaaaattctattgctactgtatcttggtatctgcattattattgcttcaagctttactataattgcaacaaatgtatgtatgcatgtatgcatgtcttttttttttttttggaataaataattgttagacaaatagtctttagacttgtgagtaagcagtatgtgatagttgataccaggtatacatatatctattaatttcttctactatgttatttgggaaaaaaagatccactttagaaagctgaagaagaaactgttgcatgaaacaactttggtgtgctggtattttatattgtcgatctcttttttttatgtgtaaggattttttacatcatttttccccctaacatttcgactttttcattgtagggcttgtaccctggatacataatattctttgttcagtcagcattaatgattgctggttccagaggtataatgttgaactttgctcatttgcggttctttcttcagttagttagttaactcgagttgctgtgtttcttttcaatcagtgatttacagatggcagcaagccgtgcctccgacaatgtctctggttaagaatgtgttggtgtttacaaattttgcttatacacttttggttctaaattactcctgtgttggtttcatggttagtcctctttcttacaagtcccccccaccccaaacaccataacacacacatgtacatttgtattttcagacttaaacaggccaatatggatttcaaagtttttttacaagttttctatgattatgtttgaataggtgttaagtctgcatgaaactcttgcatcatatggaagcgtgtattacattggaactattgttcctgttgttatgattcttcttggtaaagtaattaaacctggaaagcctgccagatctaaagctcggaaggaacagtgaggtgacaatgctgtttattcttgttggaatttttgaaatcagattaggataatgcggcagaagggtttctagttcccacaggttttctggccctggttttcaacattgttgtaacagctcctttggtcttgaaaatggttgggcgctttcatactcttggctttagcattgaattgtatttctgtgataagaaacttcttgttggcaggtttgataaaagctgttattgaagaaatgttagaaacatttgtatttctgtgatttctctctactttcagctctctctattcctaacaattactgcaagaggctctag

SEQ ID NO: 121 - DNA, 1392 bp, Glycine max
atgtccatggattctatggccacttccatcggagtctcggtccccgtgctccgcttcctcctctgcttcgccgccaccgtgcccctcagcttcctctgccgcttcctcccccgcggcctccccaagcacctctactcctccgtcgtcggcgtcgccctctcctacctctccttcggcttctcctccaacctccacttcctcgtccccatgttccttggctacgcctccatgctcctctatcgtcctcgatgcggcatcctcaccttcttcctcggatttggctacctcattggctgccacgtgtattacatgagcggtgatgcatggaaggaaggtggcatcgatgccactggggctttaatggttttgacgctcaaggttatctcctgtgcggttaattacaacgatggtttgctgaaagaggagggtttgcgtgaggctcagaagaagtaccgtttgatcaagttgccttccttgattgagtacattggttactgcctctgctgtggaagtcactttgctggtcctgtttatgaaatgaaggattatcttgattggactgaaggaaaagggatttggggcactgaagcaaaagggccatcgccatcaccttacggggcgacccttcgggctcttctccaagctggtttttgcatggccatgtatttaaacctcgtgcctcattttcctttgtccaaatttactgatcctacctaccatgaatggtgtttctggaaaaaattaagttaccagtatatgtctggctttactgcacgctggaagtattatttcatctggtcaatttcagaagcttctattatcatctctggcctggggttcagtggctggactgattcgtccccacctaagcctcgctgggaccgggccaaaaatgttgatataattggtgttgagtttgcaaagagtgcagttactattccagctgtgtggaatattcaagtcagcacctggcttcgtcattatgtttacgaaaggcttattcagactgggaagaaaccaggtttctttcagctacttgccactcagaccgttagtgccgtttggcatggcttgtaccctggatacataatattctttgttcagtcagcattaatgattgctggttccagagtgatttacagatggcagcaagccgtgcctccgacaatgtctctggttaagaatgtgttggtgtttacaaattttgcttatacacttttggttctaaattactcctgtgttggtttcatggtgttaagtctgcatgaaactcttgcatcatatggaagcgtgtattacattggaactattgttcctgttgttatgattcttcttggtaaagtaattaaacctggaaagcctgccagatctaaagctcggaaggaacagtga

SEQ ID NO: 122 - protein, 463 aa, Glycine max
MSMDSMATSIGVSVPVLRFLLCFAATVPLSFLCRFLPRGLPKHLYSSVVGVALSYLSFGFSSNLHFLVPMFLGYASMLLYRPRCGILTFFLGFGYLIGCHVYYMSGDAWKEGGIDATGALMVLTLKVISCAVNYNDGLLKEEGLREAQKKYRLIKLPSLIEYIGYCLCCGSHFAGPVYEMKDYLDWTEGKGIWGTEAKGPSPSPYGATLRALLQAGFCMAMYLNLVPHFPLSKFTDPTYHEWCFWKKLSYQYMSGFTARWKYYFIWSISEASIIISGLGFSGWTDSSPPKPRWDRAKNVDIIGVEFAKSAVTIPAVWNIQVSTWLRHYVYERLIQTGKKPGFFQLLATQTVSAVWHGLYPGYIIFFVQSALMIAGSRVIYRWQQAVPPTMSLVKNVLVFTNFAYTLLVLNYSCVGFMVLSLHETLASYGSVYYIGTIVPVVMILLGKVIKPGKPARSKARKEQ

SEQ ID NO: 123 - DNA, 4163 bp, Glycine max
gaggaagtttattaagaggttcaatcgaggtgtgttcagttgaagaagccataaataaatcttcttagcttccatcaaatctcacactctcattcttagagccatggccatggattccatggccgcttccatcggagtctcggtccccgtgctacgcttcctcctctgctttgccgccaccgtgcccctcagcttcctctgccgcctcctcccccgtggcctccccaagcacctctactccgccgccgtcggcgtcgccctctcctacctctccttcggcgtctcctccaacctccacttcctcgtccccatgttcctcggctacgcctccatgctcctctttcgtccccgatgcggcatcctcaccttcttcctcggattcggctacctcattggctggttcgtacaatcgagatctattttgtcataatctcatctcaattcaattctacttctctttgacctcgctccgcgtttgcgtttctctcttctgcagccacgtgtattacatgagcggtgacgcatggaaggaaggtggcatcgatgccactggtaagcgccaattaattatttatttattttttgaattgaggaatgagggaattgactgattagtagtatttcactggtaacgttattttttggtgatggttggttggtttggtcattaattgtggttggttggtttcggaataggggccttaatggttttgacgctcaaggttatctcctgtgcggttaattacaacgatggattgctgaaagaggagggtttgcgtgaggctcagaagaagtaccgtttgatcaaattgccttccttgattgagtacattggttactgcctctgctgcgggagtcactttgctggtcctgtttatgaaatgaaggattatcttgattggactgaaggaaaaggggtattgtttattattctgattctggttaataagaatttagcagattgcactggcattgaaatattgaatgctgaattctccttagatttgaactgaaaaaattcagtagcagagcagttactcattttttttttatgctgacaagttatgaatgactgttctcatatttgttatttcaattccttatagtctttattgtatgcggttattggcagatttggagcactgaagcaaaagggccattgccatcaccttatggggcaaccctccgggctcttctccaagctggtttttgcatggccatgtatttgaacctcgtgcctcattttcctctgtccaagtttactgatcctacctaccatgaatggtgtttctggaaaaaattaagttaccagtatatgtctggctttactgcacgttggaagtattattttatctggtcaatttcagaagcttctattataatctctggcctgggtttcagtggctggactgattcgtccccaccgaagccttgctgggaccgggccaaaaatgtagatataataggtgttgagtttgcaaagagtgcagttactattccagctgtgtggaatattcaagtcagcacctggcttcgtcattgtgagtttcttgctaatgagattgaatgcttttattgcagggtttggtttgctagctcagtaggatataatagccatcattcaatttaggcatggaacttagtttacggtcctagatgcatcatttataagttctggtaacaatttggccatagtattttttaggtggtaacatgtatggttctttaattaacatctgaatttggatggatttatcaattagcacttaatggaaaatataataaaaaaaggtaaaatgaatttagtttatcctataagttaatcagcttttggagaagttaaatgaaagagcttttatagaagttgaagtacataagttgatttttgacttgtgaaagaagctttattaattttactttttttgttttcttctcctataactataagtgcttactaagaagttataaaaaaaggacttagtctgaactttgtatcagggattagttgggtcatattaataacctctcttcttgagttagaacattgtttttgtttacactaaattatagcatgatcaagctatcaacaattgattttcaatattttttttatttttttgttcttatactgtagacttagctagatgcaaaatctcaccaaaaaaaaagctagatgcaaaattgatgtagattacatatttacatgtcattcataaagctttacaataaaatattaaatagtaatcttgttgttgtttgggttttggtagatgtttacgaaaggcttattcagactgggaagaaacctggtttcattcagctacttgccacccagaccgttagtgctgtttggcatgtgagtaaattttatctgcattttaaattgattgttttttctattgctactgtatcttggtatctgcatcattattgctttgagcttactataattgcaaatgtatgtctggtttttctttggaataactaattgttagacaaaacagttattgcacttgtgaataagcagtatgtgatagttgatgtgagttttacatatatctattaatttcttctactacgttatttggaagaataaaaaaggatccactttagaaagttgaagaagaaactgttgcatgaaacaactttgtgtgctggtattttatattgtcgattgattttttatgtgtaaggatttgttacataatttttttctgacattttgagtttatcattgtagggcttgtaccctggatacataatattctttgttcagtcagcattaatgattgctggttccagaggtatatgttgaattttgctcatttgctgttctttctttagtaagttaacttgagttgctgtgtttcttttgaaacagtcatttacagatggcagcaagccgtacctccgacgatgtctctggttaagaatgtgttggtgtttacaaattttgcttatacacttttggttctaaattactcctgcgttggtttcatggttcgtcctttttctcccctgccaccccccgccacccactgaaacacattaacacacacacacacattcaatatctcttctcagactaaaaacatgccaatatggatttcaaagttatttttacaagtttactatatgtttgaataggtgttaagtctgcatgaaacccttgcctcatatggaagcgtgtattacattggaactattattcctgttgttctgattcttcttgccaaagtaatcaaacctggaaagcctgccagatctaaagctcggaaggaacagtgaggtagaaaatgctgtttattcttgttggaaattttgaaatcagattaggagaaagcgagagaacgggtttccagtttccacaggttttctgcccctggttttcaaccttgtaacagctcctttggtcctgaatatggttgggcgctttcatactcttgcctttagcattgaactgtatttctgtgataagaaacatcttgttggcaggtttgataaaagcagttattgaagacatgttagaaacatttgtatttcggtgatttctctctactttcagctctgattcccaacaattactgcaagaggctctagttttcaaatgttaactgtagacaaatatgcagatactctgatgtatggcagtataactgtactatctagtattcatttctccaagtcacttgtcattttgtacaaaaatgatacccgccttgttggacataaagtatgggcactgttactaagaaaattttggatcggaactgcctatcataggtcttcagaattttatattttttcctgaaatgtctgggacagtgcttacccaactgacctaaggatatctaaactctgtaggtttagaatgccctgaaaatctcttttgccttaagactgagatatacgataaggtgagctagtattcttttgcatgtatggcctctaattgcctatttcaagtgtttctagaccatgccaataagaaaaaaaaggaacagggagggagagcgagaagtctccataacgttaagtttgttgaaggtgaaatgagatattcaatccaatcgaagtaccattctcgtcttaatctattcctgacgtatcagctggtttctccggaatttcagttcttaaaatgtcactaatgcaaacaaatg

SEQ ID NO: 124 - DNA, 1392 bp, Glycine max
atggccatggattccatggccgcttccatcggagtctcggtccccgtgctacgcttcctcctctgctttgccgccaccgtgcccctcagcttcctctgccgcctcctcccccgtggcctccccaagcacctctactccgccgccgtcggcgtcgccctctcctacctctccttcggcgtctcctccaacctccacttcctcgtccccatgttcctcggctacgcctccatgctcctctttcgtccccgatgcggcatcctcaccttcttcctcggattcggctacctcattggctgccacgtgtattacatgagcggtgacgcatggaaggaaggtggcatcgatgccactggggccttaatggttttgacgctcaaggttatctcctgtgcggttaattacaacgatggattgctgaaagaggagggtttgcgtgaggctcagaagaagtaccgtttgatcaaattgccttccttgattgagtacattggttactgcctctgctgcgggagtcactttgctggtcctgtttatgaaatgaaggattatcttgattggactgaaggaaaagggatttggagcactgaagcaaaagggccattgccatcaccttatggggcaaccctccgggctcttctccaagctggtttttgcatggccatgtatttgaacctcgtgcctcattttcctctgtccaagtttactgatcctacctaccatgaatggtgtttctggaaaaaattaagttaccagtatatgtctggctttactgcacgttggaagtattattttatctggtcaatttcagaagcttctattataatctctggcctgggtttcagtggctggactgattcgtccccaccgaagccttgctgggaccgggccaaaaatgtagatataataggtgttgagtttgcaaagagtgcagttactattccagctgtgtggaatattcaagtcagcacctggcttcgtcattatgtttacgaaaggcttattcagactgggaagaaacctggtttcattcagctacttgccacccagaccgttagtgctgtttggcatggcttgtaccctggatacataatattctttgttcagtcagcattaatgattgctggttccagagtcatttacagatggcagcaagccgtacctccgacgatgtctctggttaagaatgtgttggtgtttacaaattttgcttatacacttttggttctaaattactcctgcgttggtttcatggtgttaagtctgcatgaaacccttgcctcatatggaagcgtgtattacattggaactattattcctgttgttctgattcttcttgccaaagtaatcaaacctggaaagcctgccagatctaaagctcggaaggaacagtga

SEQ ID NO: 125 - protein, 463 aa, Glycine max
MAMDSMAASIGVSVPVLRFLLCFAATVPLSFLCRLLPRGLPKHLYSAAVGVALSYLSFGVSSNLHFLVPMFLGYASMLLFRPRCGILTFFLGFGYLIGCHVYYMSGDAWKEGGIDATGALMVLTLKVISCAVNYNDGLLKEEGLREAQKKYRLIKLPSLIEYIGYCLCCGSHFAGPVYEMKDYLDWTEGKGIWSTEAKGPLPSPYGATLRALLQAGFCMAMYLNLVPHFPLSKFTDPTYHEWCFWKKLSYQYMSGFTARWKYYFIWSISEASIIISGLGFSGWTDSSPPKPCWDRAKNVDIIGVEFAKSAVTIPAVWNIQVSTWLRHYVYERLIQTGKKPGFIQLLATQTVSAVWHGLYPGYIIFFVQSALMIAGSRVIYRWQQAVPPTMSLVKNVLVFTNFAYTLLVLNYSCVGFMVLSLHETLASYGSVYYIGTIIPVVLILLAKVIKPGKPARSKARKEQ

SEQ ID NO: 126 - DNA, 52 bp, Artificial Sequence
  primer
agcggccgcaccatgtccatggattctatggccacttccatcggagtctcgg

SEQ ID NO: 127 - DNA, 39 bp, Artificial Sequence
  vector
agcggccgctcactgttccttccgagctttagatctggc

SEQ ID NO: 128 - DNA, 4925 bp, Artificial Sequence
  vector
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatgtccatggattctatggccacttccatcggagtctcggtccccgtgctccgcttcctcctctgcttcgccgccaccgtgcccctcagcttcctctgccgcttcctcccccgcggcctccccaagcacctctactcctccgtcgtcggcgtcgccctctcctacctctccttcggcttctcctccaacctccacttcctcgtccccatgttccttggctacgcctccatgctcctctatcgtcctcgatgcggcatcctcaccttcttcctcggatttggctacctcattggctgccacgtgtattacatgagcggtgatgcatggaaggaaggtggcatcgatgccactggggctttaatggttttgacgctcaaggttatctcctgtgcggttaattacaacgatggtttgctgaaagaggagggtttgcgtgaggctcagaagaagtaccgtttgatcaagttgccttccttgattgagtacattggttactgcctctgctgtggaagtcactttgctggtcctgtttatgaaatgaaggattatcttgattggactgaaggaaaagggatttggggcactgaagcaaaagggccatcgccatcaccttacggggcgacccttcgggctcttctccaagctggtttttgcatggccatgtatttaaacctcgtgcctcattttcctttgtccaaatttactgatcctacctaccatgaatggtgtttctggaaaaaattaagttaccagtatatgtctggctttactgcacgctggaagtattatttcatctggtcaatttcagaagcttctattatcatctctggcctggggttcagtggctggactgattcgtccccacctaagcctcgctgggaccgggccaaaaatgttgatataattggtgttgagtttgcaaagagtgcagttactattccagctgtgtggaatattcaagtcagcacctggcttcgtcattatgtttacgaaaggcttattcagactgggaagaaaccaggtttctttcagctacttgccactcagaccgttagtgccgtttggcatggcttgtaccctggatacataatattctttgttcagtcagcattaatgattgctggttccagagtgatttacagatggcagcaagccgtgcctccgacaatgtctctggttaagaatgtgttggtgtttacaaattttgcttatacacttttggttctaaattactcctgtgttggtttcatggtgttaagtctgcatgaaactcttgcatcatatggaagcgtgtattacattggaactattgttcctgttgttatgattcttcttggtaaagtaattaaacctggaaagcctgccagatctaaagctcggaaggaacagtgagcggccgct

SEQ ID NO: 129 - DNA, 52 bp, Artificial Sequence
  primer
agcggccgcaccatggccatggattccatggccgcttccatcggagtctcgg

SEQ ID NO: 130 - DNA, 4925 bp, Artificial Sequence
  vector
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatggccatggattccatggccgcttccatcggagtctcggtccccgtgctacgcttcctcctctgctttgccgccaccgtgcccctcagcttcctctgccgcctcctcccccgtggcctccccaagcacctctactccgccgccgtcggcgtcgccctctcctacctctccttcggcgtctcctccaacctccacttcctcgtccccatgttcctcggctacgcctccatgctcctctttcgtccccgatgcggcatcctcaccttcttcctcggattcggctacctcattggctgccacgtgtattacatgagcggtgacgcatggaaggaaggtggcatcgatgccactggggccttaatggttttgacgctcaaggttatctcctgtgcggttaattacaacgatggattgctgaaagaggagggtttgcgtgaggctcagaagaagtaccgtttgatcaaattgccttccttgattgagtacattggttactgcctctgctgcgggagtcactttgctggtcctgtttatgaaatgaaggattatcttgattggactgaaggaaaagggatttggagcactgaagcaaaagggccattgccatcaccttatggggcaaccctccgggctcttctccaagctggtttttgcatggccatgtatttgaacctcgtgcctcattttcctctgtccaagtttactgatcctacctaccatgaatggtgtttctggaaaaaattaagttaccagtatatgtctggctttactgcacgttggaagtattattttatctggtcaatttcagaagcttctattataatctctggcctgggtttcagtggctggactgattcgtccccaccgaagccttgctgggaccgggccaaaaatgtagatataataggtgttgagtttgcaaagagtgcagttactattccagctgtgtggaatattcaagtcagcacctggcttcgtcattatgtttacgaaaggcttattcagactgggaagaaacctggtttcattcagctacttgccacccagaccgttagtgctgtttggcatggcttgtaccctggatacataatattctttgttcagtcagcattaatgattgctggttccagagtcatttacagatggcagcaagccgtacctccgacgatgtctctggttaagaatgtgttggtgtttacaaattttgcttatacacttttggttctaaattactcctgcgttggtttcatggtgttaagtctgcatgaaacccttgcctcatatggaagcgtgtattacattggaactattattcctgttgttctgattcttcttgccaaagtaatcaaacctggaaagcctgccagatctaaagctcggaaggaacagtgagcggccgct

SEQ ID NO: 131 - DNA, 6897 bp, Artificial Sequence
  vector
  misc_feature (4582)..(4582): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccccgggtaccgagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatgtccatggattctatggccacttccatcggagtctcggtccccgtgctccgcttcctcctctgcttcgccgccaccgtgcccctcagcttcctctgccgcttcctcccccgcggcctccccaagcacctctactcctccgtcgtcggcgtcgccctctcctacctctccttcggcttctcctccaacctccacttcctcgtccccatgttccttggctacgcctccatgctcctctatcgtcctcgatgcggcatcctcaccttcttcctcggatttggctacctcattggctgccacgtgtattacatgagcggtgatgcatggaaggaaggtggcatcgatgccactggggctttaatggttttgacgctcaaggttatctcctgtgcggttaattacaacgatggtttgctgaaagaggagggtttgcgtgaggctcagaagaagtaccgtttgatcaagttgccttccttgattgagtacattggttactgcctctgctgtggaagtcactttgctggtcctgtttatgaaatgaaggattatcttgattggactgaaggaaaagggatttggggcactgaagcaaaagggccatcgccatcaccttacggggcgacccttcgggctcttctccaagctggtttttgcatggccatgtatttaaacctcgtgcctcattttcctttgtccaaatttactgatcctacctaccatgaatggtgtttctggaaaaaattaagttaccagtatatgtctggctttactgcacgctggaagtattatttcatctggtcaatttcagaagcttctattatcatctctggcctggggttcagtggctggactgattcgtccccacctaagcctcgctgggaccgggccaaaaatgttgatataattggtgttgagtttgcaaagagtgcagttactattccagctgtgtggaatattcaagtcagcacctggcttcgtcattatgtttacgaaaggcttattcagactgggaagaaaccaggtttctttcagctacttgccactcagaccgttagtgccgtttggcatggcttgtaccctggatacataatattctttgttcagtcagcattaatgattgctggttccagagtgatttacagatggcagcaagccgtgcctccgacaatgtctctggttaagaatgtgttggtgtttacaaattttgcttatacacttttggttctaaattactcctgtgttggtttcatggtgttaagtctgcatgaaactcttgcatcatatggaagcgtgtattacattggaactattgttcctgttgttatgattcttcttggtaaagtaattaaacctggaaagcctgccagatctaaagctcggaaggaacagtgagc

SEQ ID NO: 132 - DNA, 6897 bp, Artificial Sequence
  vector
  misc_feature (4582)..(4582): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccccgggtaccgagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatggccatggattccatggccgcttccatcggagtctcggtccccgtgctacgcttcctcctctgctttgccgccaccgtgcccctcagcttcctctgccgcctcctcccccgtggcctccccaagcacctctactccgccgccgtcggcgtcgccctctcctacctctccttcggcgtctcctccaacctccacttcctcgtccccatgttcctcggctacgcctccatgctcctctttcgtccccgatgcggcatcctcaccttcttcctcggattcggctacctcattggctgccacgtgtattacatgagcggtgacgcatggaaggaaggtggcatcgatgccactggggccttaatggttttgacgctcaaggttatctcctgtgcggttaattacaacgatggattgctgaaagaggagggtttgcgtgaggctcagaagaagtaccgtttgatcaaattgccttccttgattgagtacattggttactgcctctgctgcgggagtcactttgctggtcctgtttatgaaatgaaggattatcttgattggactgaaggaaaagggatttggagcactgaagcaaaagggccattgccatcaccttatggggcaaccctccgggctcttctccaagctggtttttgcatggccatgtatttgaacctcgtgcctcattttcctctgtccaagtttactgatcctacctaccatgaatggtgtttctggaaaaaattaagttaccagtatatgtctggctttactgcacgttggaagtattattttatctggtcaatttcagaagcttctattataatctctggcctgggtttcagtggctggactgattcgtccccaccgaagccttgctgggaccgggccaaaaatgtagatataataggtgttgagtttgcaaagagtgcagttactattccagctgtgtggaatattcaagtcagcacctggcttcgtcattatgtttacgaaaggcttattcagactgggaagaaacctggtttcattcagctacttgccacccagaccgttagtgctgtttggcatggcttgtaccctggatacataatattctttgttcagtcagcattaatgattgctggttccagagtcatttacagatggcagcaagccgtacctccgacgatgtctctggttaagaatgtgttggtgtttacaaattttgcttatacacttttggttctaaattactcctgcgttggtttcatggtgttaagtctgcatgaaacccttgcctcatatggaagcgtgtattacattggaactattattcctgttgttctgattcttcttgccaaagtaatcaaacctggaaagcctgccagatctaaagctcggaaggaacagtgagc

SEQ ID NO: 133 - DNA, 12223 bp, Artificial Sequence
  vector
  misc_feature (11048)..(11048): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactgttccttccgagctttagatctggcaggctttccaggtttaattactttaccaagaagaatcataacaacaggaacaatagttccaatgtaatacacgcttccatatgatgcaagagtttcatgcagacttaacaccatgaaaccaacacaggagtaatttagaaccaaaagtgtataagcaaaatttgtaaacaccaacacattcttaaccagagacattgtcggaggcacggcttgctgccatctgtaaatcactctggaaccagcaatcattaatgctgactgaacaaagaatattatgtatccagggtacaagccatgccaaacggcactaacggtctgagtggcaagtagctgaaagaaacctggtttcttcccagtctgaataagcctttcgtaaacataatgacgaagccaggtgctgacttgaatattccacacagctggaatagtaactgcactctttgcaaactcaacaccaattatatcaacatttttggcccggtcccagcgaggcttaggtggggacgaatcagtccagccactgaaccccaggccagagatgataatagaagcttctgaaattgaccagatgaaataatacttccagcgtgcagtaaagccagacatatactggtaacttaattttttccagaaacaccattcatggtaggtaggatcagtaaatttggacaaaggaaaatgaggcacgaggtttaaatacatggccatgcaaaaaccagcttggagaagagcccgaagggtcgccccgtaaggtgatggcgatggcccttttgcttcagtgccccaaatcccttttccttcagtccaatcaagataatccttcatttcataaacaggaccagcaaagtgacttccacagcagaggcagtaaccaatgtactcaatcaaggaaggcaacttgatcaaacggtacttcttctgagcctcacgcaaaccctcctctttcagcaaaccatcgttgtaattaaccgcacaggagataaccttgagcgtcaaaaccattaaagccccagtggcatcgatgccaccttccttccatgcatcaccgctcatgtaatacacgtggcagccaatgaggtagccaaatccgaggaagaaggtgaggatgccgcatcgaggacgatagaggagcatggaggcgtagccaaggaacatggggacgaggaagtggaggttggaggagaagccgaaggagaggtaggagagggcgacgccgacgacggaggagtagaggtgcttggggaggccgcgggggaggaagcggcagaggaagctgaggggcacggtggcggcgaagcagaggaggaagcggagcacggggaccgagactccgatggaagtggccatagaatccatggacatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 134 - DNA, 12223 bp, Artificial Sequence
  vector
  misc_feature (11048)..(11048): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcactgttccttccgagctttagatctggcaggctttccaggtttgattactttggcaagaagaatcagaacaacaggaataatagttccaatgtaatacacgcttccatatgaggcaagggtttcatgcagacttaacaccatgaaaccaacgcaggagtaatttagaaccaaaagtgtataagcaaaatttgtaaacaccaacacattcttaaccagagacatcgtcggaggtacggcttgctgccatctgtaaatgactctggaaccagcaatcattaatgctgactgaacaaagaatattatgtatccagggtacaagccatgccaaacagcactaacggtctgggtggcaagtagctgaatgaaaccaggtttcttcccagtctgaataagcctttcgtaaacataatgacgaagccaggtgctgacttgaatattccacacagctggaatagtaactgcactctttgcaaactcaacacctattatatctacatttttggcccggtcccagcaaggcttcggtggggacgaatcagtccagccactgaaacccaggccagagattataatagaagcttctgaaattgaccagataaaataatacttccaacgtgcagtaaagccagacatatactggtaacttaattttttccagaaacaccattcatggtaggtaggatcagtaaacttggacagaggaaaatgaggcacgaggttcaaatacatggccatgcaaaaaccagcttggagaagagcccggagggttgccccataaggtgatggcaatggcccttttgcttcagtgctccaaatcccttttccttcagtccaatcaagataatccttcatttcataaacaggaccagcaaagtgactcccgcagcagaggcagtaaccaatgtactcaatcaaggaaggcaatttgatcaaacggtacttcttctgagcctcacgcaaaccctcctctttcagcaatccatcgttgtaattaaccgcacaggagataaccttgagcgtcaaaaccattaaggccccagtggcatcgatgccaccttccttccatgcgtcaccgctcatgtaatacacgtggcagccaatgaggtagccgaatccgaggaagaaggtgaggatgccgcatcggggacgaaagaggagcatggaggcgtagccgaggaacatggggacgaggaagtggaggttggaggagacgccgaaggagaggtaggagagggcgacgccgacggcggcggagtagaggtgcttggggaggccacgggggaggaggcggcagaggaagctgaggggcacggtggcggcaaagcagaggaggaagcgtagcacggggaccgagactccgatggaagcggccatggaatccatggccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 135 - DNA, 1560 bp, Euphorbia lagascae
  misc_feature (1555)..(1555): n is a, c, g, or t
cttcttcttcttcttcttcttcttcgtcttcctccgcctgaagaaacatggatttagaaatgaaatccatggctgcggcgatcggagtatcggtgccggtgctccggtttcttctctgttttgttgcgactattccagtgagtttcttccaccgattcatccctggtagttttgggaagcacctatatgcggctgcttctggggtttcactttcgtatctatcttttggtttctcttcaaatctccattttttggtgcctatgcttctgggatacgcttccatggttctgttccgtaaccactgtggaattattacatttattttaggatttggttatctaattggctgccatatgtattacatgagtggagatgcatggaaggaagggggcattgatgctactggagcgctaatggtgttaaccttgaaagtcatatcgtgtgctataaattacaatgatgggttattgaaagaggaggacttgagggaatctcagaagaaaaaccggttgactaagttaccctcgttgattgagtactttggttactgcctctgctgtggtagccactttgcgggtcctgtttatgaagtgaaggactatcttgagtggactgaaaggaaggggatatgggctcacaaagagaaaggaccatcaccatcaccttttggagcaaccattcgcgctcttcttcaagctgctttctgcatgggcctgtatctgtaccttgtgccccagttcccattgtcccggttcacagactctgtataccaagaatggggcttctggaaacggttaagttaccagtatatgtcaggatttacagcacgctggaaatactatttcatctggtcaatctctgaggcctctattattatctccggtctgggttttagtggctggacagatacttctccaccaaagccaaaatgggatcgtgctaaaaatgttgatattttaggcgttgagtttgcaaagagttctgttgagttgccccttgtgtggaatattcaagtcagcacatggcttcggcattatgtttatgacagactcattcaaaagggaaagaaacctggatttgttcagttgctggccactcagactactagtgctgtttggcatggattatatcctggatacatttttttctttgtccagtcagcattgatgattgccggttcaagagccatatacagatggcagcaagctgtacccccaaatttatctataatcaagcacattctcgtgtttatgaacttcgcatacacaattttggttctaaattactcatctgttggtttcatggtcttaagcttccatgaaacaattactgcatacggtagtgtatattacgtaggcactgtcgtgccgattgtattgatcgtccttggcaacataattaaaccagcgaagcctgccaggtcgaaagctcggaaagaagagtgaggtagaaactgtctttctctcttctctgcttggaacgggatcgagaactgaaaatgcggctttttacttagttgttcctttgtaacattgctgatgtttattcagaaacngccac

SEQ ID NO: 136 - DNA, 1398 bp, Euphorbia lagascae
atggatttagaaatgaaatccatggctgcggcgatcggagtatcggtgccggtgctccggtttcttctctgttttgttgcgactattccagtgagtttcttccaccgattcatccctggtagttttgggaagcacctatatgcggctgcttctggggtttcactttcgtatctatcttttggtttctcttcaaatctccattttttggtgcctatgcttctgggatacgcttccatggttctgttccgtaaccactgtggaattattacatttattttaggatttggttatctaattggctgccatatgtattacatgagtggagatgcatggaaggaagggggcattgatgctactggagcgctaatggtgttaaccttgaaagtcatatcgtgtgctataaattacaatgatgggttattgaaagaggaggacttgagggaatctcagaagaaaaaccggttgactaagttaccctcgttgattgagtactttggttactgcctctgctgtggtagccactttgcgggtcctgtttatgaagtgaaggactatcttgagtggactgaaaggaaggggatatgggctcacaaagagaaaggaccatcaccatcaccttttggagcaaccattcgcgctcttcttcaagctgctttctgcatgggcctgtatctgtaccttgtgccccagttcccattgtcccggttcacagactctgtataccaagaatggggcttctggaaacggttaagttaccagtatatgtcaggatttacagcacgctggaaatactatttcatctggtcaatctctgaggcctctattattatctccggtctgggttttagtggctggacagatacttctccaccaaagccaaaatgggatcgtgctaaaaatgttgatattttaggcgttgagtttgcaaagagttctgttgagttgccccttgtgtggaatattcaagtcagcacatggcttcggcattatgtttatgacagactcattcaaaagggaaagaaacctggatttgttcagttgctggccactcagactactagtgctgtttggcatggattatatcctggatacatttttttctttgtccagtcagcattgatgattgccggttcaagagccatatacagatggcagcaagctgtacccccaaatttatctataatcaagcacattctcgtgtttatgaacttcgcatacacaattttggttctaaattactcatctgttggtttcatggtcttaagcttccatgaaacaattactgcatacggtagtgtatattacgtaggcactgtcgtgccgattgtattgatcgtccttggcaacataattaaaccagcgaagcctgccaggtcgaaagctcggaaagaagagtga

SEQ ID NO: 137 - protein, 465 aa, Euphorbia lagascae
MDLEMKSMAAAIGVSVPVLRFLLCFVATIPVSFFHRFIPGSFGKHLYAAASGVSLSYLSFGFSSNLHFLVPMLLGYASMVLFRNHCGIITFILGFGYLIGCHMYYMSGDAWKEGGIDATGALMVLTLKVISCAINYNDGLLKEEDLRESQKKNRLTKLPSLIEYFGYCLCCGSHFAGPVYEVKDYLEWTERKGIWAHKEKGPSPSPFGATIRALLQAAFCMGLYLYLVPQFPLSRFTDSVYQEWGFWKRLSYQYMSGFTARWKYYFIWSISEASIIISGLGFSGWTDTSPPKPKWDRAKNVDILGVEFAKSSVELPLVWNIQVSTWLRHYVYDRLIQKGKKPGFVQLLATQTTSAVWHGLYPGYIFFFVQSALMIAGSRAIYRWQQAVPPNLSIIKHILVFMNFAYTILVLNYSSVGFMVLSFHETITAYGSVYYVGTVVPIVLIVLGNIIKPAKPARSKARKEE

SEQ ID NO: 138 - DNA, 38 bp, Artificial Sequence
  primer
agcggccgcaccatggatttagaaatgaaatccatggc

SEQ ID NO: 139 - DNA, 26 bp, Artificial Sequence
  primer
tgcggccgccctcactcttctttccg

SEQ ID NO: 140 - DNA, 4934 bp, Artificial Sequence
  vector
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatggatttagaaatgaaatccatggctgcggcgatcggagtatcggtgccggtgctccggtttcttctctgttttgttgcgactattccagtgagtttcttccaccgattcatccctggtagttttgggaagcacctatatgcggctgcttctggggtttcactttcgtatctatcttttggtttctcttcaaatctccattttttggtgcctatgcttctgggatacgcttccatggttctgttccgtaaccactgtggaattattacatttattttaggatttggttatctaattggctgccatatgtattacatgagtggagatgcatggaaggaagggggcattgatgctactggagcgctaatggtgttaaccttgaaagtcatatcgtgtgctataaattacaatgatgggttattgaaagaggaggacttgagggaatctcagaagaaaaaccggttgactaagttaccctcgttgattgagtactttggttactgcctctgctgtggtagccactttgcgggtcctgtttatgaagtgaaggactatcttgagtggactgaaaggaaggggatatgggctcacaaagagaaaggaccatcaccatcaccttttggagcaaccattcgcgctcttcttcaagctgctttctgcatgggcctgtatctgtaccttgtgccccagttcccattgtcccggttcacagactctgtataccaagaatggggcttctggaaacggttaagttaccagtatatgtcaggatttacagcacgctggaaatactatttcatctggtcaatctctgaggcctctattattatctccggtctgggttttagtggctggacagatacttctccaccaaagccaaaatgggatcgtgctaaaaatgttgatattttaggcgttgagtttgcaaagagttctgttgagttgccccttgtgtggaatattcaagtcagcacatggcttcggcattatgtttatgacagactcattcaaaagggaaagaaacctggatttgttcagttgctggccactcagactactagtgctgtttggcatggattatatcctggatacatttttttctttgtccagtcagcattgatgattgccggttcaagagccatatacagatggcagcaagctgtacccccaaatttatctataatcaagcacattctcgtgtttatgaacttcgcatacacaattttggttctaaattactcatctgttggtttcatggtcttaagcttccatgaaacaattactgcatacggtagtgtatattacgtaggcactgtcgtgccgattgtattgatcgtccttggcaacataattaaaccagcgaagcctgccaggtcgaaagctcggaaagaagagtgagggcggccgcacctg

SEQ ID NO: 141 - DNA, 6905 bp, Artificial Sequence
  vector
  misc_feature (4582)..(4582): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccccgggtaccgagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatggatttagaaatgaaatccatggctgcggcgatcggagtatcggtgccggtgctccggtttcttctctgttttgttgcgactattccagtgagtttcttccaccgattcatccctggtagttttgggaagcacctatatgcggctgcttctggggtttcactttcgtatctatcttttggtttctcttcaaatctccattttttggtgcctatgcttctgggatacgcttccatggttctgttccgtaaccactgtggaattattacatttattttaggatttggttatctaattggctgccatatgtattacatgagtggagatgcatggaaggaagggggcattgatgctactggagcgctaatggtgttaaccttgaaagtcatatcgtgtgctataaattacaatgatgggttattgaaagaggaggacttgagggaatctcagaagaaaaaccggttgactaagttaccctcgttgattgagtactttggttactgcctctgctgtggtagccactttgcgggtcctgtttatgaagtgaaggactatcttgagtggactgaaaggaaggggatatgggctcacaaagagaaaggaccatcaccatcaccttttggagcaaccattcgcgctcttcttcaagctgctttctgcatgggcctgtatctgtaccttgtgccccagttcccattgtcccggttcacagactctgtataccaagaatggggcttctggaaacggttaagttaccagtatatgtcaggatttacagcacgctggaaatactatttcatctggtcaatctctgaggcctctattattatctccggtctgggttttagtggctggacagatacttctccaccaaagccaaaatgggatcgtgctaaaaatgttgatattttaggcgttgagtttgcaaagagttctgttgagttgccccttgtgtggaatattcaagtcagcacatggcttcggcattatgtttatgacagactcattcaaaagggaaagaaacctggatttgttcagttgctggccactcagactactagtgctgtttggcatggattatatcctggatacatttttttctttgtccagtcagcattgatgattgccggttcaagagccatatacagatggcagcaagctgtacccccaaatttatctataatcaagcacattctcgtgtttatgaacttcgcatacacaattttggttctaaattactcatctgttggtttcatggtcttaagcttccatgaaacaattactgcatacggtagtgtatattacgtaggcactgtcgtgccgattgtattgatcgtccttggcaacataattaaaccagcgaagcctgccaggtcgaaagctcggaaagaagagtgagggc

SEQ ID NO: 142 - DNA, 12231 bp, Artificial Sequence
  vector
  misc_feature (11056)..(11056): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggaggtggtggtcgcatgtctactgtcataaccagcaacaacagtgagaagaaaggaggaagcagccaccttaagcgagcgccgcacacgaagcctcctttcacacttggtgacctcaagagagccatcccaccccattgctttgaacgctcttttgtgcgctcattctcctatgttgcctatgatgtctgcttaagttttcttttctactcgatcgccaccaacttcttcccttacatctcttctccgctctcgtatgtcgcttggctggtttactggctcttccaaggctgcattctcactggtctttgggtcatcggccatgaatgtggccatcatgcttttagtgagtatcagctggctgatgacattgttggcctaattgtccattctgcacttctggttccatatttttcatggaaatatagccatcgccgccaccattctaacataggatctctcgagcgagacgaagtgttcgtcccgaaatcaaagtcgaaaatttcatggtattctaagtacttaaacaacccgccaggtcgagttttgacacttgctgccacgctcctccttggctggcctttatatttagctttcaatgtctctggtagaccttacgatcgctttgcttgccattatgatccctatggcccaatattttccgaaagagaaaggcttcagatttacattgctgacctcggaatctttgccacaacgtttgtgctttatcaggctacaatggcaaaagggttggcttgggtaatgcgtatctatggggtgccattgcttattgttaactgtttccttgttatgatcacatacttgcagcacactcacccagctattccacgctatggctcatcggaatgggattggctccggggagcaatggtgactgtcgatagagattatggggtgttgaataaagtattccataacattgcagacactcatgtagctcatcatctctttgctacagtgccacattaccatgcaatggaggccactaaagcaatcaagcctataatgggtgagtattaccggtatgatggtaccccattttacaaggcattgtggagggaggcaaaggagtgcttgttcgtcgagccagatgaaggagctcctacacaaggcgttttctggtaccggaacaagtattaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgccctcactcttctttccgagctttcgacctggcaggcttcgctggtttaattatgttgccaaggacgatcaatacaatcggcacgacagtgcctacgtaatatacactaccgtatgcagtaattgtttcatggaagcttaagaccatgaaaccaacagatgagtaatttagaaccaaaattgtgtatgcgaagttcataaacacgagaatgtgcttgattatagataaatttgggggtacagcttgctgccatctgtatatggctcttgaaccggcaatcatcaatgctgactggacaaagaaaaaaatgtatccaggatataatccatgccaaacagcactagtagtctgagtggccagcaactgaacaaatccaggtttctttcccttttgaatgagtctgtcataaacataatgccgaagccatgtgctgacttgaatattccacacaaggggcaactcaacagaactctttgcaaactcaacgcctaaaatatcaacatttttagcacgatcccattttggctttggtggagaagtatctgtccagccactaaaacccagaccggagataataatagaggcctcagagattgaccagatgaaatagtatttccagcgtgctgtaaatcctgacatatactggtaacttaaccgtttccagaagccccattcttggtatacagagtctgtgaaccgggacaatgggaactggggcacaaggtacagatacaggcccatgcagaaagcagcttgaagaagagcgcgaatggttgctccaaaaggtgatggtgatggtcctttctctttgtgagcccatatccccttcctttcagtccactcaagatagtccttcacttcataaacaggacccgcaaagtggctaccacagcagaggcagtaaccaaagtactcaatcaacgagggtaacttagtcaaccggtttttcttctgagattccctcaagtcctcctctttcaataacccatcattgtaatttatagcacacgatatgactttcaaggttaacaccattagcgctccagtagcatcaatgcccccttccttccatgcatctccactcatgtaatacatatggcagccaattagataaccaaatcctaaaataaatgtaataattccacagtggttacggaacagaaccatggaagcgtatcccagaagcataggcaccaaaaaatggagatttgaagagaaaccaaaagatagatacgaaagtgaaaccccagaagcagccgcatataggtgcttcccaaaactaccagggatgaatcggtggaagaaactcactggaatagtcgcaacaaaacagagaagaaaccggagcaccggcaccgatactccgatcgccgcagccatggatttcatttctaaatccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 143 - DNA, 8628 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgaattcggaaaatggagcagaaaaatctctcttttccgagcattttaataagttttctgcttgttttaatcttagtagtagtcatgaggttgtggaagaaacagaatccacctccagggccatggaagtttcctatcataggtaatcttcctcatttattactcacttctgatctaggccatgaacgttttagagccttggctcaaatttatggacctgttatgagtcttcaaattggccaagtttcagctgttgtcatttcttcagctgaagcagccaaagaggttatgaaaactcaggctgatgccttcgcccaacgccctatcgtcttggacgcacagattgtgttttataatcggaaagatgtcttgtttgcttcatatggagatcactggaggcagatgaagaaaatttggatacttgaatttctgagtgccaaaaaagttcaatcctccaggttaatccgagaggaagaaatggaggatgccatcacattcctccgttcgaaagccggatctccggtcaatattacaaagatcatttatggcattataatttcgatcatgataagaacatccgttggtaattgtaagcaaaaagaaagattgctgagtgttgccgatgcagtcaatgaggcagcgacgagttttggcaccgcagacgcttttccgacgtggaaattacttcactatatcattggagctgagtcaaaacccaggcgtttgcatcaggagattgacgatatacttgaagagattcttaatgaacacaaagccaataagccttttgaagcggataacttaatggatgttctattgaatcttcaaaaaaatggaaacgttccagtgccagtgacaaacgaaagcatcaaagcatccgttttgcaaatgtttactgccgggagcgaaacaacttcgaaagctacagaatgggtaatggcagagctgatgaaaaatccaactgaactaagaaaagcacaagaagaagttagacaagtatttggtgaaatgggaaaagttgatgaatcaagatttcatgatttgaaattcttcaagttagtggttaaagaaactctaagattacatcctccggttgtcttgattccgagggagtgtagagaaacaacacgaattgatggatatgaaattcatccgaacactcgaattgttgtgaatgcttgggcgataggaagagatcctaatacttggtcggaacctggaaagtttaacccagaaaggtttaaagattgtgcaattgattataaagggacgacatttgaactggtaccatttggtgcaggaaaaagaatatgtcctggcattacttcagctattaccaatttggagtatgtcattataaatctattatatcattttaattgggaactggccgatggaattacacctcaaacacttgatatgactgaagctattggcggtgctctcaggaaaaaaatagatcttaagttgattcctattccatatcaagttagcttaggctcaaatatttcttgattacataggagggttggatccgc

SEQ ID NO: 144 - DNA, 12599 bp, Artificial Sequence
  vector
  misc_feature (11424)..(11424): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgaattcggaaaatggagcagaaaaatctctcttttccgagcattttaataagttttctgcttgttttaatcttagtagtagtcatgaggttgtggaagaaacagaatccacctccagggccatggaagtttcctatcataggtaatcttcctcatttattactcacttctgatctaggccatgaacgttttagagccttggctcaaatttatggacctgttatgagtcttcaaattggccaagtttcagctgttgtcatttcttcagctgaagcagccaaagaggttatgaaaactcaggctgatgccttcgcccaacgccctatcgtcttggacgcacagattgtgttttataatcggaaagatgtcttgtttgcttcatatggagatcactggaggcagatgaagaaaatttggatacttgaatttctgagtgccaaaaaagttcaatcctccaggttaatccgagaggaagaaatggaggatgccatcacattcctccgttcgaaagccggatctccggtcaatattacaaagatcatttatggcattataatttcgatcatgataagaacatccgttggtaattgtaagcaaaaagaaagattgctgagtgttgccgatgcagtcaatgaggcagcgacgagttttggcaccgcagacgcttttccgacgtggaaattacttcactatatcattggagctgagtcaaaacccaggcgtttgcatcaggagattgacgatatacttgaagagattcttaatgaacacaaagccaataagccttttgaagcggataacttaatggatgttctattgaatcttcaaaaaaatggaaacgttccagtgccagtgacaaacgaaagcatcaaagcatccgttttgcaaatgtttactgccgggagcgaaacaacttcgaaagctacagaatgggtaatggcagagctgatgaaaaatccaactgaactaagaaaagcacaagaagaagttagacaagtatttggtgaaatgggaaaagttgatgaatcaagatttcatgatttgaaattcttcaagttagtggttaaagaaactctaagattacatcctccggttgtcttgattccgagggagtgtagagaaacaacacgaattgatggatatgaaattcatccgaacactcgaattgttgtgaatgcttgggcgataggaagagatcctaatacttggtcggaacctggaaagtttaacccagaaaggtttaaagattgtgcaattgattataaagggacgacatttgaactggtaccatttggtgcaggaaaaagaatatgtcctggcattacttcagctattaccaatttggagtatgtcattataaatctattatatcattttaattgggaactggccgatggaattacacctcaaacacttgatatgactgaagctattggcggtgctctcaggaaaaaaatagatcttaagttgattcctattccatatcaagttagcttaggctcaaatatttcttgattacataggagggttggatccgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgccctcactcttctttccgagctttcgacctggcaggcttcgctggtttaattatgttgccaaggacgatcaatacaatcggcacgacagtgcctacgtaatatacactaccgtatgcagtaattgtttcatggaagcttaagaccatgaaaccaacagatgagtaatttagaaccaaaattgtgtatgcgaagttcataaacacgagaatgtgcttgattatagataaatttgggggtacagcttgctgccatctgtatatggctcttgaaccggcaatcatcaatgctgactggacaaagaaaaaaatgtatccaggatataatccatgccaaacagcactagtagtctgagtggccagcaactgaacaaatccaggtttctttcccttttgaatgagtctgtcataaacataatgccgaagccatgtgctgacttgaatattccacacaaggggcaactcaacagaactctttgcaaactcaacgcctaaaatatcaacatttttagcacgatcccattttggctttggtggagaagtatctgtccagccactaaaacccagaccggagataataatagaggcctcagagattgaccagatgaaatagtatttccagcgtgctgtaaatcctgacatatactggtaacttaaccgtttccagaagccccattcttggtatacagagtctgtgaaccgggacaatgggaactggggcacaaggtacagatacaggcccatgcagaaagcagcttgaagaagagcgcgaatggttgctccaaaaggtgatggtgatggtcctttctctttgtgagcccatatccccttcctttcagtccactcaagatagtccttcacttcataaacaggacccgcaaagtggctaccacagcagaggcagtaaccaaagtactcaatcaacgagggtaacttagtcaaccggtttttcttctgagattccctcaagtcctcctctttcaataacccatcattgtaatttatagcacacgatatgactttcaaggttaacaccattagcgctccagtagcatcaatgcccccttccttccatgcatctccactcatgtaatacatatggcagccaattagataaccaaatcctaaaataaatgtaataattccacagtggttacggaacagaaccatggaagcgtatcccagaagcataggcaccaaaaaatggagatttgaagagaaaccaaaagatagatacgaaagtgaaaccccagaagcagccgcatataggtgcttcccaaaactaccagggatgaatcggtggaagaaactcactggaatagtcgcaacaaaacagagaagaaaccggagcaccggcaccgatactccgatcgccgcagccatggatttcatttctaaatccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 145 - DNA, 17155 bp, Artificial Sequence
  vector
gatccgcccactcgaggcgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacg

SEQ ID NO: 146 - DNA, 11836 bp, Artificial Sequence
  vector
catgaatcaaacaaacatacacagcgacttattcacacgagctcaaattacaacggtatatatcctgccgtcgacttaattcagggcgcgccagtcgtacccggggctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagctggggatccggataatggcggcggctgcggcggctccatctccctctttctccaaaaccctatcgtcctcctcctccaaatcctccaccctcctccctagatccaccttccctttcccccaccacccccacaaaaccaccccaccacccctccacctcacccccacccacattcacagccaacgccgtcgtttcaccatctccaatgtcatttccactacccaaaaagtttccgagacccaaaaagccgaaactttcgtttcccgttttgcccctgacgaacccagaaagggttccgacgttctcgtggaggccctcgaaagagaaggggttacggacgtttttgcgtacccaggcggcgcttccatggagattcaccaagctttgacccgttcaagcatcatccgcaacgtgctgccacgtcacgagcagggcggtgtcttcgccgctgagggttacgcacgcgccaccggatttcccggcgtttgcattgccacctctggccccggcgccaccaatctcgtcagcggcctcgctgacgcgctactggatagcgtccccattgttgctataacaggtcaagtggcacgtaggatgataggtactgatgcttttcaggaaactcctattgttgaggtaactagatcgattaccaagcataattatctcgttatggacgtagaggatattcctagggttgtacgtgaagcttttttcctcgcgagatcgggccggcctggccctattttgattgatgtacctaaggatattcagcaacaattggtgatacctgactgggatcagccaatgaggttacctggttacatgtctaggttgcctaaattgcccaatgagatgcttttagaacaaattgttaggcttatttctgagtcaaagaagcctgttttgtatgtggggggtgggtgttcgcaatcgagtgaggacttgagacgattcgtggagctcacgggtatccccgtggcaagtactttgatgggtcttggagcttttccaactggggatgagctttccctttcaatgttgggtatgcatggtactgtttatgctaattatgctgtggacagtagtgatttgttgctcgcatttggggtgaggtttgatgatagagttactggaaagttagaagcttttgctagccgagcaaaaattgttcacattgatattgattcagctgagattggaaagaacaagcagcctcatgtttccatttgtgcagatatcaagttggcgttacagggtttgaattcgatactggagagtaaggaaggtaaactgaagttggatttttctgcttggaggcaggagttgacggagcagaaagtgaagcacccattgaactttaaaacttttggtgatgcaattcctccgcaatatgctatccaggttctagatgagttaactaatgggaatgctattataagtactggtgtggggcaacaccagatgtgggctgctcaatactataagtacagaaagccacgccaatggttgacatctggtggattaggagcaatgggatttggtttgcccgctgctattggtgcggctgttggaagaccggatgaagttgtggttgacattgatggtgatggcagtttcatcatgaatgtgcaggagcttgcaacaattaaggtggagaatctcccagttaagattatgttactgaataatcaacacttgggaatggtggttcaattggaggatcggttctataaggctaacagagcacacacatacctggggaatccttctaatgaggcggagatctttcctaatatgttgaaatttgcagaggcttgtggcgtacctgctgcgagagtgacacacagggatgatcttagagcggctattcaaaagatgttagacactcctgggccatacttgttggatgtgattgtacctcatcaggaacatgttctacctatgattcccagtggcggggctttcaaagatgtgatcacagagggtgacgggagaagttcctattgactttgaggtgctacagagctagttctaggccttgtattatctaaaataaacttctattaaaccaaaaatgttatgtctattagtttgttattagtttttccgtggctttgctcattgtcagtgttgtactattaagtagttgatatttatgtttgctttaagttttgcatcatctcgctttggttttgaatgtgaaggatttcagcaatgtttcattctctattcgcaacatccagtcggtatccggagctctatgtagtatgtctggagattaatttctagtggagtagtttagtgcgataaagttagcttgttccacatttttatttcgtaacctgggtcagattggaacttcctctttaggttggatgcaatccctatttgggctttctcttaatttcattattgaaattgttggcttttaatctgagcaagttgatttgcagctttctctcttgagtcctagcgagcaatacgttatctctgtctcctatttcttagtggataatcttatgatggaaatctgtggagataggaaactgttgactgctcattctctctttgtgaggcgtctgacagttacgctttcaatctatagcagttcgatcagactttctttgcttataacaatactagatacagttggaccgtgtagcacgggcccaacaatttgtgtaacgttatctttaattcaaaatatctttcatgatttttgtaattttattaagaaaatcagttaataacataaatgactaagttagagtagcatctttgtaccattttgcccattgctttttattttcttgtttcaatgttatttgacaatatagatgtattttcctgcatctatagcattagcagtcttgttaatatgagctagtatattggtttttatggcaatacttcaatatcttattagttactgcaccatgaaaagaaataaagttctctaatagaaaataagaaactgtgttacagctcaaatattctcattagattgatacttacttcaggaaagaaaatattgtacacaactcctacattttgttatattctgggaaaacttcaacaatatgaagtccaacaaaaatcattctatcatcaagaataaagggaagtcgcattggaaaaacagcagcatcaacttgtcaattctattctagagctctctattggcagaatcatgtggtccaggttctctctatctgcacaatcttttggttcaggtttttcttgccgataattttctgtaattcaactataactatcctggatggtagtgtgtaagcacagtggatgtcatggtcagaatagaacaactgctgcggattttttgcatcaaatgtgagttcttttttggacgtctccccggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggaacatccaacgtcgctttcagggatagcttatcgatgggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtaaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggcccaccgcccacctgggtggagctgggttaagccaccccattgaggttcacggaatggaaaggctacaaagcgggccttttgtcgtggtcccgggggaattaaagggcaccccgccatccggccggtgaaggtttcccgagggcgcttggccggggttccaagccttgcccaccgcccagcggcaacgcttcgagccagaagcacgcccgggtgaatcgtggcaagcggccgctgatcgaatccgcaaagattcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcaattccggggtcgatatggctattacgaagaaggctcgtgcgcggagccccgtgaactttcccacgcaacaagtgaaccgcaccgggtttgccggaggccatttcgttaaaatgcgcagc

SEQ ID NO: 147 - DNA, 8488 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtccatggattctatggccacttccatcggagtctcggtccccgtgctccgcttcctcctctgcttcgccgccaccgtgcccctcagcttcctctgccgcttcctcccccgcggcctccccaagcacctctactcctccgtcgtcggcgtcgccctctcctacctctccttcggcttctcctccaacctccacttcctcgtccccatgttccttggctacgcctccatgctcctctatcgtcctcgatgcggcatcctcaccttcttcctcggatttggctacctcattggctgccacgtgtattacatgagcggtgatgcatggaaggaaggtggcatcgatgccactggggctttaatggttttgacgctcaaggttatctcctgtgcggttaattacaacgatggtttgctgaaagaggagggtttgcgtgaggctcagaagaagtaccgtttgatcaagttgccttccttgattgagtacattggttactgcctctgctgtggaagtcactttgctggtcctgtttatgaaatgaaggattatcttgattggactgaaggaaaagggatttggggcactgaagcaaaagggccatcgccatcaccttacggggcgacccttcgggctcttctccaagctggtttttgcatggccatgtatttaaacctcgtgcctcattttcctttgtccaaatttactgatcctacctaccatgaatggtgtttctggaaaaaattaagttaccagtatatgtctggctttactgcacgctggaagtattatttcatctggtcaatttcagaagcttctattatcatctctggcctggggttcagtggctggactgattcgtccccacctaagcctcgctgggaccgggccaaaaatgttgatataattggtgttgagtttgcaaagagtgcagttactattccagctgtgtggaatattcaagtcagcacctggcttcgtcattatgtttacgaaaggcttattcagactgggaagaaaccaggtttctttcagctacttgccactcagaccgttagtgccgtttggcatggcttgtaccctggatacataatattctttgttcagtcagcattaatgattgctggttccagagtgatttacagatggcagcaagccgtgcctccgacaatgtctctggttaagaatgtgttggtgtttacaaattttgcttatacacttttggttctaaattactcctgtgttggtttcatggtgttaagtctgcatgaaactcttgcatcatatggaagcgtgtattacattggaactattgttcctgttgttatgattcttcttggtaaagtaattaaacctggaaagcctgccagatctaaagctcggaaggaacagtgagc

SEQ ID NO: 148 - DNA, 8488 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggccatggattccatggccgcttccatcggagtctcggtccccgtgctacgcttcctcctctgctttgccgccaccgtgcccctcagcttcctctgccgcctcctcccccgtggcctccccaagcacctctactccgccgccgtcggcgtcgccctctcctacctctccttcggcgtctcctccaacctccacttcctcgtccccatgttcctcggctacgcctccatgctcctctttcgtccccgatgcggcatcctcaccttcttcctcggattcggctacctcattggctgccacgtgtattacatgagcggtgacgcatggaaggaaggtggcatcgatgccactggggccttaatggttttgacgctcaaggttatctcctgtgcggttaattacaacgatggattgctgaaagaggagggtttgcgtgaggctcagaagaagtaccgtttgatcaaattgccttccttgattgagtacattggttactgcctctgctgcgggagtcactttgctggtcctgtttatgaaatgaaggattatcttgattggactgaaggaaaagggatttggagcactgaagcaaaagggccattgccatcaccttatggggcaaccctccgggctcttctccaagctggtttttgcatggccatgtatttgaacctcgtgcctcattttcctctgtccaagtttactgatcctacctaccatgaatggtgtttctggaaaaaattaagttaccagtatatgtctggctttactgcacgttggaagtattattttatctggtcaatttcagaagcttctattataatctctggcctgggtttcagtggctggactgattcgtccccaccgaagccttgctgggaccgggccaaaaatgtagatataataggtgttgagtttgcaaagagtgcagttactattccagctgtgtggaatattcaagtcagcacctggcttcgtcattatgtttacgaaaggcttattcagactgggaagaaacctggtttcattcagctacttgccacccagaccgttagtgctgtttggcatggcttgtaccctggatacataatattctttgttcagtcagcattaatgattgctggttccagagtcatttacagatggcagcaagccgtacctccgacgatgtctctggttaagaatgtgttggtgtttacaaattttgcttatacacttttggttctaaattactcctgcgttggtttcatggtgttaagtctgcatgaaacccttgcctcatatggaagcgtgtattacattggaactattattcctgttgttctgattcttcttgccaaagtaatcaaacctggaaagcctgccagatctaaagctcggaaggaacagtgagc

SEQ ID NO: 149 - DNA, 8485 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtcaatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatgagc

SEQ ID NO: 150 - DNA, 8494 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtgagc

SEQ ID NO: 151 - DNA, 5884 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtgagc

SEQ ID NO: 152 - DNA, 5773 bp, Artificial Sequence
  vector
gtacgagatccgcccatccggccggccagatcctgcaggagatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaac

SEQ ID NO: 153 - DNA, 5775 bp, Artificial Sequence
  vector
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgagatccgcccatccggccggccagatcctgcaggagatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggatttagaaatgaaatccatggctgcggcgatcggagtatcggtgccggtgctccggtttcttctctgttttgttgcgactattccagtgagtttcttccaccgattcatccctggtagttttgggaagcacctatatgcggctgcttctggggtttcactttcgtatctatcttttggtttctcttcaaatctccattttttggtgcctatgcttctgggatacgcttccatggttctgttccgtaaccactgtggaattattacatttattttaggatttggttatctaattggctgccatatgtattacatgagtggagatgcatggaaggaagggggcattgatgctactggagcgctaatggtgttaaccttgaaagtcatatcgtgtgctataaattacaatgatgggttattgaaagaggaggacttgagggaatctcagaagaaaaaccggttgactaagttaccctcgttgattgagtactttggttactgcctctgctgtggtagccactttgcgggtcctgtttatgaagtgaaggactatcttgagtggactgaaaggaaggggatatgggctcacaaagagaaaggaccatcaccatcaccttttggagcaaccattcgcgctcttcttcaagctgctttctgcatgggcctgtatctgtaccttgtgccccagttcccattgtcccggttcacagactctgtataccaagaatggggcttctggaaacggttaagttaccagtatatgtcaggatttacagcacgctggaaatactatttcatctggtcaatctctgaggcctctattattatctccggtctgggttttagtggctggacagatacttctccaccaaagccaaaatgggatcgtgctaaaaatgttgatattttaggcgttgagtttgcaaagagttctgttgagttgccccttgtgtggaatattcaagtcagcacatggcttcggcattatgtttatgacagactcattcaaaagggaaagaaacctggatttgttcagttgctggccactcagactactagtgctgtttggcatggattatatcctggatacatttttttctttgtccagtcagcattgatgattgccggttcaagagccatatacagatggcagcaagctgtacccccaaatttatctataatcaagcacattctcgtgtttatgaacttcgcatacacaattttggttctaaattactcatctgttggtttcatggtcttaagcttccatgaaacaattactgcatacggtagtgtatattacgtaggcactgtcgtgccgattgtattgatcgtccttggcaacataattaaaccagcgaagcctgccaggtcgaaagctcggaaagaagagtgagggc

SEQ ID NO: 154 - DNA, 15084 bp, Artificial Sequence
  vector
cgcgccctgaattaagtcgacggcaggatatataccgttgtaatttgagctcgtgtgaataagtcgctgtgtatgtttgtttgattcatggctgcgcattttaacgaaatggcctccggcaaacccggtgcggttcacttgttgcgtgggaaagttcacggggctccgcgcacgagccttcttcgtaatagccatatcgaccccggaattgacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggaatctttgcggattcgatcagcggccgcttgccacgattcacccgggcgtgcttctggctcgaagcgttgccgctgggcggtgggcaaggcttggaaccccggccaagcgccctcgggaaaccttcaccggccggatggcggggtgccctttaattcccccgggaccacgacaaaaggcccgctttgtagcctttccattccgtgaacctcaatggggtggcttaacccagctccacccaggtgggcggtgggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattaccttacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccacccatcgataagctatccctgaaagcgacgttggatgttccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccggggagacgtccaaaaaagaactcacatttgatgcaaaaaatccgcagcagttgttctattctgaccatgacatccactgtgcttacacactaccatccaggatagttatagttgaattacagaaaattatcggcaagaaaaacctgaaccaaaagattgtgcagatagagagaacctggaccacatgattctgccaatagagagctctagaatagaattgacaagttgatgctgctgtttttccaatgcgacttccctttattcttgatgatagaatgatttttgttggacttcatattgttgaagttttcccagaatataacaaaatgtaggagttgtgtacaatattttctttcctgaagtaagtatcaatctaatgagaatatttgagctgtaacacagtttcttattttctattagagaactttatttcttttcatggtgcagtaactaataagatattgaagtattgccataaaaaccaatatactagctcatattaacaagactgctaatgctatagatgcaggaaaatacatctatattgtcaaataacattgaaacaagaaaataaaaagcaatgggcaaaatggtacaaagatgctactctaacttagtcatttatgttattaactgattttcttaataaaattacaaaaatcatgaaagatattttgaattaaagataacgttacacaaattgttgggcccgtgctacacggtccaactgtatctagtattgttataagcaaagaaagtctgatcgaactgctatagattgaaagcgtaactgtcagacgcctcacaaagagagaatgagcagtcaacagtttcctatctccacagatttccatcataagattatccactaagaaataggagacagagataacgtattgctcgctaggactcaagagagaaagctgcaaatcaacttgctcagattaaaagccaacaatttcaataatgaaattaagagaaagcccaaatagggattgcatccaacctaaagaggaagttccaatctgacccaggttacgaaataaaaatgtggaacaagctaactttatcgcactaaactactccactagaaattaatctccagacatactacatagagctccggataccgactggatgttgcgaatagagaatgaaacattgctgaaatccttcacattcaaaaccaaagcgagatgatgcaaaacttaaagcaaacataaatatcaactacttaatagtacaacactgacaatgagcaaagccacggaaaaactaataacaaactaatagacataacatttttggtttaatagaagtttattttagataatacaaggcctagaactagctctgtagcacctcaaagtcaataggaacttctcccgtcaccctctgtgatcacatctttgaaagccccgccactgggaatcataggtagaacatgttcctgatgaggtacaatcacatccaacaagtatggcccaggagtgtctaacatcttttgaatagccgctctaagatcatccctgtgtgtcactctcgcagcaggtacgccacaagcctctgcaaatttcaacatattaggaaagatctccgcctcattagaaggattccccaggtatgtgtgtgctctgttagccttatagaaccgatcctccaattgaaccaccattcccaagtgttgattattcagtaacataatcttaactgggagattctccaccttaattgttgcaagctcctgcacattcatgatgaaactgccatcaccatcaatgtcaaccacaacttcatccggtcttccaacagccgcaccaatagcagcgggcaaaccaaatcccattgctcctaatccaccagatgtcaaccattggcgtggctttctgtacttatagtattgagcagcccacatctggtgttgccccacaccagtacttataatagcattcccattagttaactcatctagaacctggatagcatattgcggaggaattgcatcaccaaaagttttaaagttcaatgggtgcttcactttctgctccgtcaactcctgcctccaagcagaaaaatccaacttcagtttaccttccttactctccagtatcgaattcaaaccctgtaacgccaacttgatatctgcacaaatggaaacatgaggctgcttgttctttccaatctcagctgaatcaatatcaatgtgaacaatttttgctcggctagcaaaagcttctaactttccagtaactctatcatcaaacctcaccccaaatgcgagcaacaaatcactactgtccacagcataattagcataaacagtaccatgcatacccaacattgaaagggaaagctcatccccagttggaaaagctccaagacccatcaaagtacttgccacggggatacccgtgagctccacgaatcgtctcaagtcctcactcgattgcgaacacccaccccccacatacaaaacaggcttctttgactcagaaataagcctaacaatttgttctaaaagcatctcattgggcaatttaggcaacctagacatgtaaccaggtaacctcattggctgatcccagtcaggtatcaccaattgttgctgaatatccttaggtacatcaatcaaaatagggccaggccggcccgatctcgcgaggaaaaaagcttcacgtacaaccctaggaatatcctctacgtccataacgagataattatgcttggtaatcgatctagttacctcaacaataggagtttcctgaaaagcatcagtacctatcatcctacgtgccacttgacctgttatagcaacaatggggacgctatccagtagcgcgtcagcgaggccgctgacgagattggtggcgccggggccagaggtggcaatgcaaacgccgggaaatccggtggcgcgtgcgtaaccctcagcggcgaagacaccgccctgctcgtgacgtggcagcacgttgcggatgatgcttgaacgggtcaaagcttggtgaatctccatggaagcgccgcctgggtacgcaaaaacgtccgtaaccccttctctttcgagggcctccacgagaacgtcggaaccctttctgggttcgtcaggggcaaaacgggaaacgaaagtttcggctttttgggtctcggaaactttttgggtagtggaaatgacattggagatggtgaaacgacggcgttggctgtgaatgtgggtgggggtgaggtggaggggtggtggggtggttttgtgggggtggtgggggaaagggaaggtggatctagggaggagggtggaggatttggaggaggaggacgatagggttttggagaaagagggagatggagccgccgcagccgccgccattatccggatccccagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagccccgggtacgactggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtccatggattctatggccacttccatcggagtctcggtccccgtgctccgcttcctcctctgcttcgccgccaccgtgcccctcagcttcctctgccgcttcctcccccgcggcctccccaagcacctctactcctccgtcgtcggcgtcgccctctcctacctctccttcggcttctcctccaacctccacttcctcgtccccatgttccttggctacgcctccatgctcctctatcgtcctcgatgcggcatcctcaccttcttcctcggatttggctacctcattggctgccacgtgtattacatgagcggtgatgcatggaaggaaggtggcatcgatgccactggggctttaatggttttgacgctcaaggttatctcctgtgcggttaattacaacgatggtttgctgaaagaggagggtttgcgtgaggctcagaagaagtaccgtttgatcaagttgccttccttgattgagtacattggttactgcctctgctgtggaagtcactttgctggtcctgtttatgaaatgaaggattatcttgattggactgaaggaaaagggatttggggcactgaagcaaaagggccatcgccatcaccttacggggcgacccttcgggctcttctccaagctggtttttgcatggccatgtatttaaacctcgtgcctcattttcctttgtccaaatttactgatcctacctaccatgaatggtgtttctggaaaaaattaagttaccagtatatgtctggctttactgcacgctggaagtattatttcatctggtcaatttcagaagcttctattatcatctctggcctggggttcagtggctggactgattcgtccccacctaagcctcgctgggaccgggccaaaaatgttgatataattggtgttgagtttgcaaagagtgcagttactattccagctgtgtggaatattcaagtcagcacctggcttcgtcattatgtttacgaaaggcttattcagactgggaagaaaccaggtttctttcagctacttgccactcagaccgttagtgccgtttggcatggcttgtaccctggatacataatattctttgttcagtcagcattaatgattgctggttccagagtgatttacagatggcagcaagccgtgcctccgacaatgtctctggttaagaatgtgttggtgtttacaaattttgcttatacacttttggttctaaattactcctgtgttggtttcatggtgttaagtctgcatgaaactcttgcatcatatggaagcgtgtattacattggaactattgttcctgttgttatgattcttcttggtaaagtaattaaacctggaaagcctgccagatctaaagctcggaaggaacagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 155 - DNA, 15084 bp, Artificial Sequence
  vector
cgcgccctgaattaagtcgacggcaggatatataccgttgtaatttgagctcgtgtgaataagtcgctgtgtatgtttgtttgattcatggctgcgcattttaacgaaatggcctccggcaaacccggtgcggttcacttgttgcgtgggaaagttcacggggctccgcgcacgagccttcttcgtaatagccatatcgaccccggaattgacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggaatctttgcggattcgatcagcggccgcttgccacgattcacccgggcgtgcttctggctcgaagcgttgccgctgggcggtgggcaaggcttggaaccccggccaagcgccctcgggaaaccttcaccggccggatggcggggtgccctttaattcccccgggaccacgacaaaaggcccgctttgtagcctttccattccgtgaacctcaatggggtggcttaacccagctccacccaggtgggcggtgggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattaccttacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccacccatcgataagctatccctgaaagcgacgttggatgttccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccggggagacgtccaaaaaagaactcacatttgatgcaaaaaatccgcagcagttgttctattctgaccatgacatccactgtgcttacacactaccatccaggatagttatagttgaattacagaaaattatcggcaagaaaaacctgaaccaaaagattgtgcagatagagagaacctggaccacatgattctgccaatagagagctctagaatagaattgacaagttgatgctgctgtttttccaatgcgacttccctttattcttgatgatagaatgatttttgttggacttcatattgttgaagttttcccagaatataacaaaatgtaggagttgtgtacaatattttctttcctgaagtaagtatcaatctaatgagaatatttgagctgtaacacagtttcttattttctattagagaactttatttcttttcatggtgcagtaactaataagatattgaagtattgccataaaaaccaatatactagctcatattaacaagactgctaatgctatagatgcaggaaaatacatctatattgtcaaataacattgaaacaagaaaataaaaagcaatgggcaaaatggtacaaagatgctactctaacttagtcatttatgttattaactgattttcttaataaaattacaaaaatcatgaaagatattttgaattaaagataacgttacacaaattgttgggcccgtgctacacggtccaactgtatctagtattgttataagcaaagaaagtctgatcgaactgctatagattgaaagcgtaactgtcagacgcctcacaaagagagaatgagcagtcaacagtttcctatctccacagatttccatcataagattatccactaagaaataggagacagagataacgtattgctcgctaggactcaagagagaaagctgcaaatcaacttgctcagattaaaagccaacaatttcaataatgaaattaagagaaagcccaaatagggattgcatccaacctaaagaggaagttccaatctgacccaggttacgaaataaaaatgtggaacaagctaactttatcgcactaaactactccactagaaattaatctccagacatactacatagagctccggataccgactggatgttgcgaatagagaatgaaacattgctgaaatccttcacattcaaaaccaaagcgagatgatgcaaaacttaaagcaaacataaatatcaactacttaatagtacaacactgacaatgagcaaagccacggaaaaactaataacaaactaatagacataacatttttggtttaatagaagtttattttagataatacaaggcctagaactagctctgtagcacctcaaagtcaataggaacttctcccgtcaccctctgtgatcacatctttgaaagccccgccactgggaatcataggtagaacatgttcctgatgaggtacaatcacatccaacaagtatggcccaggagtgtctaacatcttttgaatagccgctctaagatcatccctgtgtgtcactctcgcagcaggtacgccacaagcctctgcaaatttcaacatattaggaaagatctccgcctcattagaaggattccccaggtatgtgtgtgctctgttagccttatagaaccgatcctccaattgaaccaccattcccaagtgttgattattcagtaacataatcttaactgggagattctccaccttaattgttgcaagctcctgcacattcatgatgaaactgccatcaccatcaatgtcaaccacaacttcatccggtcttccaacagccgcaccaatagcagcgggcaaaccaaatcccattgctcctaatccaccagatgtcaaccattggcgtggctttctgtacttatagtattgagcagcccacatctggtgttgccccacaccagtacttataatagcattcccattagttaactcatctagaacctggatagcatattgcggaggaattgcatcaccaaaagttttaaagttcaatgggtgcttcactttctgctccgtcaactcctgcctccaagcagaaaaatccaacttcagtttaccttccttactctccagtatcgaattcaaaccctgtaacgccaacttgatatctgcacaaatggaaacatgaggctgcttgttctttccaatctcagctgaatcaatatcaatgtgaacaatttttgctcggctagcaaaagcttctaactttccagtaactctatcatcaaacctcaccccaaatgcgagcaacaaatcactactgtccacagcataattagcataaacagtaccatgcatacccaacattgaaagggaaagctcatccccagttggaaaagctccaagacccatcaaagtacttgccacggggatacccgtgagctccacgaatcgtctcaagtcctcactcgattgcgaacacccaccccccacatacaaaacaggcttctttgactcagaaataagcctaacaatttgttctaaaagcatctcattgggcaatttaggcaacctagacatgtaaccaggtaacctcattggctgatcccagtcaggtatcaccaattgttgctgaatatccttaggtacatcaatcaaaatagggccaggccggcccgatctcgcgaggaaaaaagcttcacgtacaaccctaggaatatcctctacgtccataacgagataattatgcttggtaatcgatctagttacctcaacaataggagtttcctgaaaagcatcagtacctatcatcctacgtgccacttgacctgttatagcaacaatggggacgctatccagtagcgcgtcagcgaggccgctgacgagattggtggcgccggggccagaggtggcaatgcaaacgccgggaaatccggtggcgcgtgcgtaaccctcagcggcgaagacaccgccctgctcgtgacgtggcagcacgttgcggatgatgcttgaacgggtcaaagcttggtgaatctccatggaagcgccgcctgggtacgcaaaaacgtccgtaaccccttctctttcgagggcctccacgagaacgtcggaaccctttctgggttcgtcaggggcaaaacgggaaacgaaagtttcggctttttgggtctcggaaactttttgggtagtggaaatgacattggagatggtgaaacgacggcgttggctgtgaatgtgggtgggggtgaggtggaggggtggtggggtggttttgtgggggtggtgggggaaagggaaggtggatctagggaggagggtggaggatttggaggaggaggacgatagggttttggagaaagagggagatggagccgccgcagccgccgccattatccggatccccagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagccccgggtacgactggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggccatggattccatggccgcttccatcggagtctcggtccccgtgctacgcttcctcctctgctttgccgccaccgtgcccctcagcttcctctgccgcctcctcccccgtggcctccccaagcacctctactccgccgccgtcggcgtcgccctctcctacctctccttcggcgtctcctccaacctccacttcctcgtccccatgttcctcggctacgcctccatgctcctctttcgtccccgatgcggcatcctcaccttcttcctcggattcggctacctcattggctgccacgtgtattacatgagcggtgacgcatggaaggaaggtggcatcgatgccactggggccttaatggttttgacgctcaaggttatctcctgtgcggttaattacaacgatggattgctgaaagaggagggtttgcgtgaggctcagaagaagtaccgtttgatcaaattgccttccttgattgagtacattggttactgcctctgctgcgggagtcactttgctggtcctgtttatgaaatgaaggattatcttgattggactgaaggaaaagggatttggagcactgaagcaaaagggccattgccatcaccttatggggcaaccctccgggctcttctccaagctggtttttgcatggccatgtatttgaacctcgtgcctcattttcctctgtccaagtttactgatcctacctaccatgaatggtgtttctggaaaaaattaagttaccagtatatgtctggctttactgcacgttggaagtattattttatctggtcaatttcagaagcttctattataatctctggcctgggtttcagtggctggactgattcgtccccaccgaagccttgctgggaccgggccaaaaatgtagatataataggtgttgagtttgcaaagagtgcagttactattccagctgtgtggaatattcaagtcagcacctggcttcgtcattatgtttacgaaaggcttattcagactgggaagaaacctggtttcattcagctacttgccacccagaccgttagtgctgtttggcatggcttgtaccctggatacataatattctttgttcagtcagcattaatgattgctggttccagagtcatttacagatggcagcaagccgtacctccgacgatgtctctggttaagaatgtgttggtgtttacaaattttgcttatacacttttggttctaaattactcctgcgttggtttcatggtgttaagtctgcatgaaacccttgcctcatatggaagcgtgtattacattggaactattattcctgttgttctgattcttcttgccaaagtaatcaaacctggaaagcctgccagatctaaagctcggaaggaacagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 156 - DNA, 15081 bp, Artificial Sequence
  vector
catgaatcaaacaaacatacacagcgacttattcacacgagctcaaattacaacggtatatatcctgccgtcgacttaattcagggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggatatggaatcaacggcgacggctatcggagtatcggtgccggtactccgattccttctatgcttcgtcgccactattcctgccggctttttccatcgcctcatccccggcggccccaccggaaaacacttgtacgccgcctctaccggcgttgtactctcttacttatcctttggtttctcttcaaatctacactttctcgtgcctatgttggtcagttacgtgtcaatggtggtctatcggaaacgatgcggcttaattacattcgtgttagctatgggatacctcattggatgccatgtatactacatgagtggggatgcatggaaggaaggaggtattgatgctactggagctcttatggtaataacattaaaagttatttcgtgcgcgattaattacaatgatggattactaaaagatgaagatcttcgcgaatcccagaagaaaaatcagttacttaagctgccttctttaatcgagtatgtgggattttgtctttgttgtggaagtcattttgcaggcccagtttatgaaattaaggattacttagattggacagaaggcaaagggatctggataaagtcggaaaagggttcaccatcacctttcgggccaaccgtcaaagctcttgttcaagctggtgtctgtatgggtttgtacttatatttggtacctcattacccgttatcaaaattcactgacccgatatataaagaatggggattctggaaacgattgagttaccaatacatggcgggctttacggcccgttggaaatattatttcatatggtccatttcagaagcttctattgttatttctggtttgggctttagtgggtgggccgattcttctccacccaaggcccggtgggaccgggctaaaaatgttgatgttttgggtgttgagtttgctaggagtgcagtggagataccacttgtatggaatattcaagtcagcacatggcttcgtcactatgtttatgacagacttgttaaaaaggggaaaaaggctggtttcttccaattgcttgcaacacagactgttagtgctgtatggcatggattatatccagggtacatcatattttttgttcaatcagctttgatgattgctggttcaagagccatttacagatggcagcaatctgttcccccaaatttggggttgcttaagaagatttttatgcttgtaaacttcgcttatacacttctcgttctcaactactcatgtgttggtttcatggtattaagcctacacgaaacagtgactgcatacgggagtgtatactacattggaactattattcctgtggttttaatccttcttggtaatgtaatcaaaacaaagcctgttagatctaaagcacgaaaagatcaatgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccagtcgtacccggggctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagctggggatccggataatggcggcggctgcggcggctccatctccctctttctccaaaaccctatcgtcctcctcctccaaatcctccaccctcctccctagatccaccttccctttcccccaccacccccacaaaaccaccccaccacccctccacctcacccccacccacattcacagccaacgccgtcgtttcaccatctccaatgtcatttccactacccaaaaagtttccgagacccaaaaagccgaaactttcgtttcccgttttgcccctgacgaacccagaaagggttccgacgttctcgtggaggccctcgaaagagaaggggttacggacgtttttgcgtacccaggcggcgcttccatggagattcaccaagctttgacccgttcaagcatcatccgcaacgtgctgccacgtcacgagcagggcggtgtcttcgccgctgagggttacgcacgcgccaccggatttcccggcgtttgcattgccacctctggccccggcgccaccaatctcgtcagcggcctcgctgacgcgctactggatagcgtccccattgttgctataacaggtcaagtggcacgtaggatgataggtactgatgcttttcaggaaactcctattgttgaggtaactagatcgattaccaagcataattatctcgttatggacgtagaggatattcctagggttgtacgtgaagcttttttcctcgcgagatcgggccggcctggccctattttgattgatgtacctaaggatattcagcaacaattggtgatacctgactgggatcagccaatgaggttacctggttacatgtctaggttgcctaaattgcccaatgagatgcttttagaacaaattgttaggcttatttctgagtcaaagaagcctgttttgtatgtggggggtgggtgttcgcaatcgagtgaggacttgagacgattcgtggagctcacgggtatccccgtggcaagtactttgatgggtcttggagcttttccaactggggatgagctttccctttcaatgttgggtatgcatggtactgtttatgctaattatgctgtggacagtagtgatttgttgctcgcatttggggtgaggtttgatgatagagttactggaaagttagaagcttttgctagccgagcaaaaattgttcacattgatattgattcagctgagattggaaagaacaagcagcctcatgtttccatttgtgcagatatcaagttggcgttacagggtttgaattcgatactggagagtaaggaaggtaaactgaagttggatttttctgcttggaggcaggagttgacggagcagaaagtgaagcacccattgaactttaaaacttttggtgatgcaattcctccgcaatatgctatccaggttctagatgagttaactaatgggaatgctattataagtactggtgtggggcaacaccagatgtgggctgctcaatactataagtacagaaagccacgccaatggttgacatctggtggattaggagcaatgggatttggtttgcccgctgctattggtgcggctgttggaagaccggatgaagttgtggttgacattgatggtgatggcagtttcatcatgaatgtgcaggagcttgcaacaattaaggtggagaatctcccagttaagattatgttactgaataatcaacacttgggaatggtggttcaattggaggatcggttctataaggctaacagagcacacacatacctggggaatccttctaatgaggcggagatctttcctaatatgttgaaatttgcagaggcttgtggcgtacctgctgcgagagtgacacacagggatgatcttagagcggctattcaaaagatgttagacactcctgggccatacttgttggatgtgattgtacctcatcaggaacatgttctacctatgattcccagtggcggggctttcaaagatgtgatcacagagggtgacgggagaagttcctattgactttgaggtgctacagagctagttctaggccttgtattatctaaaataaacttctattaaaccaaaaatgttatgtctattagtttgttattagtttttccgtggctttgctcattgtcagtgttgtactattaagtagttgatatttatgtttgctttaagttttgcatcatctcgctttggttttgaatgtgaaggatttcagcaatgtttcattctctattcgcaacatccagtcggtatccggagctctatgtagtatgtctggagattaatttctagtggagtagtttagtgcgataaagttagcttgttccacatttttatttcgtaacctgggtcagattggaacttcctctttaggttggatgcaatccctatttgggctttctcttaatttcattattgaaattgttggcttttaatctgagcaagttgatttgcagctttctctcttgagtcctagcgagcaatacgttatctctgtctcctatttcttagtggataatcttatgatggaaatctgtggagataggaaactgttgactgctcattctctctttgtgaggcgtctgacagttacgctttcaatctatagcagttcgatcagactttctttgcttataacaatactagatacagttggaccgtgtagcacgggcccaacaatttgtgtaacgttatctttaattcaaaatatctttcatgatttttgtaattttattaagaaaatcagttaataacataaatgactaagttagagtagcatctttgtaccattttgcccattgctttttattttcttgtttcaatgttatttgacaatatagatgtattttcctgcatctatagcattagcagtcttgttaatatgagctagtatattggtttttatggcaatacttcaatatcttattagttactgcaccatgaaaagaaataaagttctctaatagaaaataagaaactgtgttacagctcaaatattctcattagattgatacttacttcaggaaagaaaatattgtacacaactcctacattttgttatattctgggaaaacttcaacaatatgaagtccaacaaaaatcattctatcatcaagaataaagggaagtcgcattggaaaaacagcagcatcaacttgtcaattctattctagagctctctattggcagaatcatgtggtccaggttctctctatctgcacaatcttttggttcaggtttttcttgccgataattttctgtaattcaactataactatcctggatggtagtgtgtaagcacagtggatgtcatggtcagaatagaacaactgctgcggattttttgcatcaaatgtgagttcttttttggacgtctccccggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggaacatccaacgtcgctttcagggatagcttatcgatgggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtaaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggcccaccgcccacctgggtggagctgggttaagccaccccattgaggttcacggaatggaaaggctacaaagcgggccttttgtcgtggtcccgggggaattaaagggcaccccgccatccggccggtgaaggtttcccgagggcgcttggccggggttccaagccttgcccaccgcccagcggcaacgcttcgagccagaagcacgcccgggtgaatcgtggcaagcggccgctgatcgaatccgcaaagattcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcaattccggggtcgatatggctattacgaagaaggctcgtgcgcggagccccgtgaactttcccacgcaacaagtgaaccgcaccgggtttgccggaggccatttcgttaaaatgcgcagc

SEQ ID NO: 157 - DNA, 15090 bp, Artificial Sequence
  vector
cgcgccctgaattaagtcgacggcaggatatataccgttgtaatttgagctcgtgtgaataagtcgctgtgtatgtttgtttgattcatggctgcgcattttaacgaaatggcctccggcaaacccggtgcggttcacttgttgcgtgggaaagttcacggggctccgcgcacgagccttcttcgtaatagccatatcgaccccggaattgacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggaatctttgcggattcgatcagcggccgcttgccacgattcacccgggcgtgcttctggctcgaagcgttgccgctgggcggtgggcaaggcttggaaccccggccaagcgccctcgggaaaccttcaccggccggatggcggggtgccctttaattcccccgggaccacgacaaaaggcccgctttgtagcctttccattccgtgaacctcaatggggtggcttaacccagctccacccaggtgggcggtgggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattaccttacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccacccatcgataagctatccctgaaagcgacgttggatgttccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccggggagacgtccaaaaaagaactcacatttgatgcaaaaaatccgcagcagttgttctattctgaccatgacatccactgtgcttacacactaccatccaggatagttatagttgaattacagaaaattatcggcaagaaaaacctgaaccaaaagattgtgcagatagagagaacctggaccacatgattctgccaatagagagctctagaatagaattgacaagttgatgctgctgtttttccaatgcgacttccctttattcttgatgatagaatgatttttgttggacttcatattgttgaagttttcccagaatataacaaaatgtaggagttgtgtacaatattttctttcctgaagtaagtatcaatctaatgagaatatttgagctgtaacacagtttcttattttctattagagaactttatttcttttcatggtgcagtaactaataagatattgaagtattgccataaaaaccaatatactagctcatattaacaagactgctaatgctatagatgcaggaaaatacatctatattgtcaaataacattgaaacaagaaaataaaaagcaatgggcaaaatggtacaaagatgctactctaacttagtcatttatgttattaactgattttcttaataaaattacaaaaatcatgaaagatattttgaattaaagataacgttacacaaattgttgggcccgtgctacacggtccaactgtatctagtattgttataagcaaagaaagtctgatcgaactgctatagattgaaagcgtaactgtcagacgcctcacaaagagagaatgagcagtcaacagtttcctatctccacagatttccatcataagattatccactaagaaataggagacagagataacgtattgctcgctaggactcaagagagaaagctgcaaatcaacttgctcagattaaaagccaacaatttcaataatgaaattaagagaaagcccaaatagggattgcatccaacctaaagaggaagttccaatctgacccaggttacgaaataaaaatgtggaacaagctaactttatcgcactaaactactccactagaaattaatctccagacatactacatagagctccggataccgactggatgttgcgaatagagaatgaaacattgctgaaatccttcacattcaaaaccaaagcgagatgatgcaaaacttaaagcaaacataaatatcaactacttaatagtacaacactgacaatgagcaaagccacggaaaaactaataacaaactaatagacataacatttttggtttaatagaagtttattttagataatacaaggcctagaactagctctgtagcacctcaaagtcaataggaacttctcccgtcaccctctgtgatcacatctttgaaagccccgccactgggaatcataggtagaacatgttcctgatgaggtacaatcacatccaacaagtatggcccaggagtgtctaacatcttttgaatagccgctctaagatcatccctgtgtgtcactctcgcagcaggtacgccacaagcctctgcaaatttcaacatattaggaaagatctccgcctcattagaaggattccccaggtatgtgtgtgctctgttagccttatagaaccgatcctccaattgaaccaccattcccaagtgttgattattcagtaacataatcttaactgggagattctccaccttaattgttgcaagctcctgcacattcatgatgaaactgccatcaccatcaatgtcaaccacaacttcatccggtcttccaacagccgcaccaatagcagcgggcaaaccaaatcccattgctcctaatccaccagatgtcaaccattggcgtggctttctgtacttatagtattgagcagcccacatctggtgttgccccacaccagtacttataatagcattcccattagttaactcatctagaacctggatagcatattgcggaggaattgcatcaccaaaagttttaaagttcaatgggtgcttcactttctgctccgtcaactcctgcctccaagcagaaaaatccaacttcagtttaccttccttactctccagtatcgaattcaaaccctgtaacgccaacttgatatctgcacaaatggaaacatgaggctgcttgttctttccaatctcagctgaatcaatatcaatgtgaacaatttttgctcggctagcaaaagcttctaactttccagtaactctatcatcaaacctcaccccaaatgcgagcaacaaatcactactgtccacagcataattagcataaacagtaccatgcatacccaacattgaaagggaaagctcatccccagttggaaaagctccaagacccatcaaagtacttgccacggggatacccgtgagctccacgaatcgtctcaagtcctcactcgattgcgaacacccaccccccacatacaaaacaggcttctttgactcagaaataagcctaacaatttgttctaaaagcatctcattgggcaatttaggcaacctagacatgtaaccaggtaacctcattggctgatcccagtcaggtatcaccaattgttgctgaatatccttaggtacatcaatcaaaatagggccaggccggcccgatctcgcgaggaaaaaagcttcacgtacaaccctaggaatatcctctacgtccataacgagataattatgcttggtaatcgatctagttacctcaacaataggagtttcctgaaaagcatcagtacctatcatcctacgtgccacttgacctgttatagcaacaatggggacgctatccagtagcgcgtcagcgaggccgctgacgagattggtggcgccggggccagaggtggcaatgcaaacgccgggaaatccggtggcgcgtgcgtaaccctcagcggcgaagacaccgccctgctcgtgacgtggcagcacgttgcggatgatgcttgaacgggtcaaagcttggtgaatctccatggaagcgccgcctgggtacgcaaaaacgtccgtaaccccttctctttcgagggcctccacgagaacgtcggaaccctttctgggttcgtcaggggcaaaacgggaaacgaaagtttcggctttttgggtctcggaaactttttgggtagtggaaatgacattggagatggtgaaacgacggcgttggctgtgaatgtgggtgggggtgaggtggaggggtggtggggtggttttgtgggggtggtgggggaaagggaaggtggatctagggaggagggtggaggatttggaggaggaggacgatagggttttggagaaagagggagatggagccgccgcagccgccgccattatccggatccccagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagccccgggtacgactggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggcctggagatggaacccctcgccgcctccattggcatctccgtccccgttctccgcttcctcctctgcttcgtcgccacaatcccggtcagtttcctatggcgtctcgtccccggccgcctccccaagcacctctactccgccctctccggcgttcttctctcttacctctccttcggcttctcttccaacctccatttcttggtccccatgtccctgggttacgcttccatgctcctcttccaccgccattgcggcttcattaccttctttttgggtttcggctatctcattggctgccatgtatattacatgagtggggacgcttggaaggaaggaggtattgatgcaactggggccttgatggtattgacactgaaagtcatttcatgtgcaataaattataatgatgggttgttaaaagaagaaggtttaagtgaggctcaaaagaaaaatcgattgattaagttgccctcatcaatcgagtacatcggttattgcctctgctgtggcagccactttgctggtcctgtttatgaaatgaaggattatcttgagtggactgaaggaaatgggatttggaagcatgatgaacaaaacccatctccatcaccatatttcgctacaattcgagctcttttccaagctgccttttgtatgggcttgtatttgtacctggtacctcagtttccattgtcccgctttattgatcccgtctaccttgaatggccattctggaagcgtcttgggtaccagtatatggcaggctttacagcacgctggaaatattatttcatctggtcgatttcggaggctgccatcattatttccggcttgggtttcagtggttggacaaagtcttctccacccaaaccgagctgggaccgtgcaataaacgtcgatattataggtcttgagttggtgaagagtgcagttgagattcctcttaaatggaatattcaagtcagcacctggcttcgtcattatgtttatgagaggctggttcaaaaggggaagagacctggtttctttcagctgctggcaacacagactgtcagtgctgtttggcatggtctgtatcctgggtacataatcttctttgttcagtctgctctgatgattgctggttcaagagttatttacagatggcaagtagctgttcctccaaccttggctttcctcaaaatcatactcggattttttaactttgcttacacagttttggttctgaactattcctgcgtcggtttcatggtcttgagtttgcacgagacgcttgcctcgtatggaagcgtgtactacatcggaaccgtcattcccgtcacactgatcttacttggctccataattaaacccgcaagaccggttcgatccaaagctcgaaaagaagagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 158 - DNA, 15097 bp, Artificial Sequence
  vector
cgcgccctgaattaagtcgacggcaggatatataccgttgtaatttgagctcgtgtgaataagtcgctgtgtatgtttgtttgattcatggctgcgcattttaacgaaatggcctccggcaaacccggtgcggttcacttgttgcgtgggaaagttcacggggctccgcgcacgagccttcttcgtaatagccatatcgaccccggaattgacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggaatctttgcggattcgatcagcggccgcttgccacgattcacccgggcgtgcttctggctcgaagcgttgccgctgggcggtgggcaaggcttggaaccccggccaagcgccctcgggaaaccttcaccggccggatggcggggtgccctttaattcccccgggaccacgacaaaaggcccgctttgtagcctttccattccgtgaacctcaatggggtggcttaacccagctccacccaggtgggcggtgggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattaccttacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccacccatcgataagctatccctgaaagcgacgttggatgttccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccggggagacgtccaaaaaagaactcacatttgatgcaaaaaatccgcagcagttgttctattctgaccatgacatccactgtgcttacacactaccatccaggatagttatagttgaattacagaaaattatcggcaagaaaaacctgaaccaaaagattgtgcagatagagagaacctggaccacatgattctgccaatagagagctctagaatagaattgacaagttgatgctgctgtttttccaatgcgacttccctttattcttgatgatagaatgatttttgttggacttcatattgttgaagttttcccagaatataacaaaatgtaggagttgtgtacaatattttctttcctgaagtaagtatcaatctaatgagaatatttgagctgtaacacagtttcttattttctattagagaactttatttcttttcatggtgcagtaactaataagatattgaagtattgccataaaaaccaatatactagctcatattaacaagactgctaatgctatagatgcaggaaaatacatctatattgtcaaataacattgaaacaagaaaataaaaagcaatgggcaaaatggtacaaagatgctactctaacttagtcatttatgttattaactgattttcttaataaaattacaaaaatcatgaaagatattttgaattaaagataacgttacacaaattgttgggcccgtgctacacggtccaactgtatctagtattgttataagcaaagaaagtctgatcgaactgctatagattgaaagcgtaactgtcagacgcctcacaaagagagaatgagcagtcaacagtttcctatctccacagatttccatcataagattatccactaagaaataggagacagagataacgtattgctcgctaggactcaagagagaaagctgcaaatcaacttgctcagattaaaagccaacaatttcaataatgaaattaagagaaagcccaaatagggattgcatccaacctaaagaggaagttccaatctgacccaggttacgaaataaaaatgtggaacaagctaactttatcgcactaaactactccactagaaattaatctccagacatactacatagagctccggataccgactggatgttgcgaatagagaatgaaacattgctgaaatccttcacattcaaaaccaaagcgagatgatgcaaaacttaaagcaaacataaatatcaactacttaatagtacaacactgacaatgagcaaagccacggaaaaactaataacaaactaatagacataacatttttggtttaatagaagtttattttagataatacaaggcctagaactagctctgtagcacctcaaagtcaataggaacttctcccgtcaccctctgtgatcacatctttgaaagccccgccactgggaatcataggtagaacatgttcctgatgaggtacaatcacatccaacaagtatggcccaggagtgtctaacatcttttgaatagccgctctaagatcatccctgtgtgtcactctcgcagcaggtacgccacaagcctctgcaaatttcaacatattaggaaagatctccgcctcattagaaggattccccaggtatgtgtgtgctctgttagccttatagaaccgatcctccaattgaaccaccattcccaagtgttgattattcagtaacataatcttaactgggagattctccaccttaattgttgcaagctcctgcacattcatgatgaaactgccatcaccatcaatgtcaaccacaacttcatccggtcttccaacagccgcaccaatagcagcgggcaaaccaaatcccattgctcctaatccaccagatgtcaaccattggcgtggctttctgtacttatagtattgagcagcccacatctggtgttgccccacaccagtacttataatagcattcccattagttaactcatctagaacctggatagcatattgcggaggaattgcatcaccaaaagttttaaagttcaatgggtgcttcactttctgctccgtcaactcctgcctccaagcagaaaaatccaacttcagtttaccttccttactctccagtatcgaattcaaaccctgtaacgccaacttgatatctgcacaaatggaaacatgaggctgcttgttctttccaatctcagctgaatcaatatcaatgtgaacaatttttgctcggctagcaaaagcttctaactttccagtaactctatcatcaaacctcaccccaaatgcgagcaacaaatcactactgtccacagcataattagcataaacagtaccatgcatacccaacattgaaagggaaagctcatccccagttggaaaagctccaagacccatcaaagtacttgccacggggatacccgtgagctccacgaatcgtctcaagtcctcactcgattgcgaacacccaccccccacatacaaaacaggcttctttgactcagaaataagcctaacaatttgttctaaaagcatctcattgggcaatttaggcaacctagacatgtaaccaggtaacctcattggctgatcccagtcaggtatcaccaattgttgctgaatatccttaggtacatcaatcaaaatagggccaggccggcccgatctcgcgaggaaaaaagcttcacgtacaaccctaggaatatcctctacgtccataacgagataattatgcttggtaatcgatctagttacctcaacaataggagtttcctgaaaagcatcagtacctatcatcctacgtgccacttgacctgttatagcaacaatggggacgctatccagtagcgcgtcagcgaggccgctgacgagattggtggcgccggggccagaggtggcaatgcaaacgccgggaaatccggtggcgcgtgcgtaaccctcagcggcgaagacaccgccctgctcgtgacgtggcagcacgttgcggatgatgcttgaacgggtcaaagcttggtgaatctccatggaagcgccgcctgggtacgcaaaaacgtccgtaaccccttctctttcgagggcctccacgagaacgtcggaaccctttctgggttcgtcaggggcaaaacgggaaacgaaagtttcggctttttgggtctcggaaactttttgggtagtggaaatgacattggagatggtgaaacgacggcgttggctgtgaatgtgggtgggggtgaggtggaggggtggtggggtggttttgtgggggtggtgggggaaagggaaggtggatctagggaggagggtggaggatttggaggaggaggacgatagggttttggagaaagagggagatggagccgccgcagccgccgccattatccggatccccagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagccccgggtacgactggcgcgccgtcgacggatccgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggatttagaaatgaaatccatggctgcggcgatcggagtatcggtgccggtgctccggtttcttctctgttttgttgcgactattccagtgagtttcttccaccgattcatccctggtagttttgggaagcacctatatgcggctgcttctggggtttcactttcgtatctatcttttggtttctcttcaaatctccattttttggtgcctatgcttctgggatacgcttccatggttctgttccgtaaccactgtggaattattacatttattttaggatttggttatctaattggctgccatatgtattacatgagtggagatgcatggaaggaagggggcattgatgctactggagcgctaatggtgttaaccttgaaagtcatatcgtgtgctataaattacaatgatgggttattgaaagaggaggacttgagggaatctcagaagaaaaaccggttgactaagttaccctcgttgattgagtactttggttactgcctctgctgtggtagccactttgcgggtcctgtttatgaagtgaaggactatcttgagtggactgaaaggaaggggatatgggctcacaaagagaaaggaccatcaccatcaccttttggagcaaccattcgcgctcttcttcaagctgctttctgcatgggcctgtatctgtaccttgtgccccagttcccattgtcccggttcacagactctgtataccaagaatggggcttctggaaacggttaagttaccagtatatgtcaggatttacagcacgctggaaatactatttcatctggtcaatctctgaggcctctattattatctccggtctgggttttagtggctggacagatacttctccaccaaagccaaaatgggatcgtgctaaaaatgttgatattttaggcgttgagtttgcaaagagttctgttgagttgccccttgtgtggaatattcaagtcagcacatggcttcggcattatgtttatgacagactcattcaaaagggaaagaaacctggatttgttcagttgctggccactcagactactagtgctgtttggcatggattatatcctggatacatttttttctttgtccagtcagcattgatgattgccggttcaagagccatatacagatggcagcaagctgtacccccaaatttatctataatcaagcacattctcgtgtttatgaacttcgcatacacaattttggttctaaattactcatctgttggtttcatggtcttaagcttccatgaaacaattactgcatacggtagtgtatattacgtaggcactgtcgtgccgattgtattgatcgtccttggcaacataattaaaccagcgaagcctgccaggtcgaaagctcggaaagaagagtgagggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgagatccgcccatccggccggccagatcctgcaggagatccaagcttgg

The invention claimed is:

1. An isolated polynucleotide comprising:
    (a) a nucleotide sequence encoding a polypeptide with membrane-bound O-acyltransferase (MBOAT) activity, wherein, based on the Clustal V method of alignment with pairwise alignment default parameters of KTUPLE=1, GAP PENALTY=3, WINDOW=5 and DIAGONALS SAVED=5, the polypeptide has an amino acid sequence of at least 85% sequence identity when compared to SEQ ID NO:12; or
    (b) the full complement of the nucleotide sequence of (a); and a heterologous promoter operably linked to either (a) or (b).

2. The polynucleotide of claim 1, wherein the amino acid sequence of the polypeptide comprises SEQ ID NO:12.

3. A host cell comprising in its genome the polynucleotide of claims 1 or 2, wherein the host cell is selected from the group consisting of a plant cell, a microbial cell, and a yeast cell.

4. A method for producing a transformed plant comprising
    (a) transforming a plant cell with the polynucleotide of claim 1 or 2; and
    (b) regenerating a plant from the transformed plant cell of step (a).

5. The method of claim 4 wherein the plant is an oilseed plant selected from the group consisting of soybean, *Brassica* species, sunflower, maize, cotton, flax, and safflower.

6. The method of claim 5 wherein the plant is a soybean plant.

7. A transgenic seed comprising in its genome the polynucleotide of claims 1 or 2.

8. A transgenic seed obtained from the plant made by the method of claim 4; comprising said polynucleotide.

9. A method for increasing the content of at least one unusual fatty acid in an oilseed plant cell comprising:
    (a) transforming the oilseed plant cell with:
        (i) the polynucleotide of claims 1 or 2; and
        (ii) at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18/20 elongase, a C20/22 elongase, a DGAT, an MBOAT, a fatty acid conjugase, a hydroxylase, an acetylenase, an epoxidase, and a multizyme;
    (b) regenerating an oilseed plant from the transformed cell of step (a); and
    (c) selecting those seeds obtained from the plants of step (b) having an increased level of at least one unusual fatty acid selected from the group consisting of GLA, STA, EDA, ERA, DGLA, ETA, ARA, and EPA; when compared to—the level in seeds obtained from a transgenic plant comprising at least one recombinant construct comprising an isolated polynucleotide, operably linked to at least one regulatory sequence, encoding the same polypeptide as encoded by the isolated polynucleotide of step (a)(ii), but not comprising the polynucleotide of claims 1 or 2.

10. A method for increasing at least one conversion efficiency, wherein said conversion efficiency is at least one selected from the group consisting of: $C_{18}$ to $C_{20}$ elongation, delta-6 desaturation, delta-9 elongation, delta-8 desaturation, conjugation to Eleostearic acid, and conjugation to Calendic acid, in an oilseed plant cell comprising:
    (a) transforming the oilseed plant cell with:
        (i) the polynucleotide of claims 1 or 2; and
        (ii) at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a C14/16 elongase, a C16/18 elongase, a C18/20 elongase, a C20/22 elongase, a DGAT, an MBOAT, a fatty acid conjugase, a hydroxylase, an acetylenase, an epoxidase, and a multizyme;
(b) regenerating an oilseed plant from the transformed cell of step (a); and
(c) selecting those seeds obtained from the plants of step (b) having an increased $C_{18}$ to $C_{20}$ elongation conversion efficiency and an increased delta-6 desaturation conversion efficiency; when compared to the level in seeds obtained from a transgenic plant comprising at least one recombinant construct comprising an isolated polynucleotide, operably linked to at least one regulatory sequence, encoding the same polypeptide as encoded by the isolated polynucleotide of step (a)(ii), but not comprising the polynucleotide of claims 1 or 2.

11. The method of claim 10 wherein the increase of at least one of the conversion efficiencies is at least one selected from the group consisting of:
the increase of $C_{18}$ to $C_{20}$ elongation conversion efficiency by least 1.1-fold, the delta-6 desaturation conversion efficiency by at least 2-fold, the delta-9 elongation conversion efficiency by at least 1.1-fold, the delta-8 desaturation conversion efficiency by at least 1.2-fold, the conjugation conversion efficiency to Eleostearic acid by least 1.2-fold, and the conjugation conversion efficiency to Calendic acid by at least 2.5-fold.

12. An oil seed plant or oil seed comprising:
(a the polynucleotide of claims 1 or 2; and
(b) at least one additional recombinant construct comprising an isolated polynucleotide, operably linked to at least one regulatory sequence, encoding a polypeptide selected from the group consisting of a delta-4 desaturase, a delta-5 desaturase, a delta-6 desaturase, a delta-8 desaturase, a delta-12 desaturase, a delta-15 desaturase, a delta-17 desaturase, a delta-9 desaturase, a delta-9 elongase, a 014/16 elongase, a 016/18 elongase, a 018/20 elongase, a C20/22 elongase, a DGAT, an MBOAT, a fatty acid conjugase, a hydroxylase, an acetylenase, an epoxidase, and a multizyme.

13. The oilseed plant of claim 12, wherein the oilseed plant is selected from the group consisting of soybean, *Brassica* species, sunflower, maize, cotton, flax, and safflower.

14. A transgenic seed obtained from the oilseed plant of claim 13, wherein said seed comprises the polynucleotide of (a) and the recombinant DNA construct of (b).

15. Food or feed comprising the seed of claim 14.

16. Progeny plants obtained from the oilseed plant of claim 12, wherein said progeny plants comprise the polynucleotide of (a) and the recombinant DNA construct of (b).

\* \* \* \* \*